US007824898B2

(12) United States Patent
Davis et al.

(10) Patent No.: US 7,824,898 B2
(45) Date of Patent: Nov. 2, 2010

(54) HALOHYDRIN DEHALOGENASES AND RELATED POLYNUCLEOTIDES

(75) Inventors: S. Christopher Davis, San Francisco, CA (US); Richard John Fox, Kirkwood, MO (US); Gjalt W. Huisman, San Carlos, CA (US); Vesna Gavrilovic, Mountain View, CA (US); Lisa Marie Newman, Redwood City, CA (US)

(73) Assignee: Codexis, Inc., Redwood City, CA (US)

( * ) Notice: Subject to any disclaimer, the term of this patent is extended or adjusted under 35 U.S.C. 154(b) by 1178 days.

(21) Appl. No.: 10/917,179

(22) Filed: Aug. 11, 2004

(65) Prior Publication Data
US 2005/0153417 A1 Jul. 14, 2005

Related U.S. Application Data

(60) Provisional application No. 60/494,382, filed on Aug. 11, 2003, provisional application No. 60/546,033, filed on Feb. 18, 2004.

(51) Int. Cl.
C12N 9/88 (2006.01)
C07K 14/00 (2006.01)
(52) U.S. Cl. ..................................... 435/232; 530/350
(58) Field of Classification Search .................. None
See application file for complete search history.

(56) References Cited

U.S. PATENT DOCUMENTS

| | | | |
|---|---|---|---|
| 5,166,061 A | 11/1992 | Nakamura et al. | |
| 5,210,031 A | 5/1993 | Nakamura et al. | |
| 5,430,171 A | 7/1995 | Mitsuhashi et al. | |
| 5,908,953 A | 6/1999 | Matsuda et al. | |
| 6,001,615 A | 12/1999 | Reeve | |
| 6,344,569 B1 | 2/2002 | Mitsuda et al. | |
| 6,472,544 B1 | 10/2002 | Kizaki et al. | |
| 6,596,879 B2 | 7/2003 | Bosch et al. | |
| 6,645,746 B1 | 11/2003 | Kizaki et al. | |
| 6,689,591 B2 | 2/2004 | Müller et al. | |
| 7,125,693 B2 | 10/2006 | Davis et al. | |
| 7,132,267 B2 | 11/2006 | Davis et al. | |
| 7,588,928 B2 | 9/2009 | Davis et al. | |
| 2004/0137585 A1 | 7/2004 | Davis et al. | |
| 2005/0153417 A1 | 7/2005 | Davis et al. | |
| 2005/0272064 A1 | 12/2005 | Davis et al. | |
| 2007/0161094 A1 | 7/2007 | Davis et al. | |

FOREIGN PATENT DOCUMENTS

| | | |
|---|---|---|
| EP | 0879890 A1 | 5/1997 |
| EP | 1 158 054 A1 | 11/2001 |
| JP | 04-278089 A | 10/1992 |
| JP | 10-210981 A | 8/1998 |
| WO | WO 98/53081 A1 | 11/1998 |
| WO | WO 01/90397 A1 | 11/2001 |
| WO | WO-2004/015132 A | 2/2004 |
| WO | WO 2005/017141 A1 | 2/2005 |
| WO | WO 2005/018579 A2 | 3/2005 |

OTHER PUBLICATIONS

Van Hylckama et al, << Halohydrin Dehalogenases Are Structurally and Mechanistically Related To Short-Chain Dehydrogenases/Reductases, Journal of Bacteriology, vol. 183 No. 17, Sep. 2001, pp. 5058-5066, XP002305277, ISSN: 0021-9193.
Tang et al, "Steady-State Kinetics and Tryptophan Fluorescence Properties of Halohydrin Dehalogenase From Agrobacterium Radiobacter. Roles of W139 and W249 In The Active Site and Halide-Induced Conformational Change", Biochemistry, vol. 42 No. 47, Dec. 2003, pp. 14057-14065, XP002305278, ISSNL 0006-2960.
De Jong et al, "Structure and Mechanism Of A Bacterial Haloalcohol Dehalogenase: A New Variation Of The Short-Chain Dehydrogenase/Reductase Fold Without An NAD(P)H Binding Site", EMBO (European Molecular Biology Organization) Journal, vol. 22 No. 19, Oct. 2003, pp. 4933-4944, XP002305279, ISSN: 0261-4189.
Lewis M., "Agrobacterium Tumefaciens Haloalcohol Dehalogenase B Gene, Complete CDS", Database EMBL 'Online!, Jun. 1999, XP002305665, retrieved from EBI accession No. EM_PRO: AF149769, database accession No. AF149769.
Supplementary European Search Report for 06735244.3 dated Jul. 9, 2009.
Tang et al., 2002, "Improved Stability of Halohydrin Dehalogenase from *Agrobacterium Radiobacter* AD1 by Replacement of Cysteine Residues," *Enzyme Microb. Technol.*, 30:251-258.
Archer, 1997, "Epoxide Hydrolases as Asymmetric Catalysts," *Tetrahedron, Elsevier Science*, 53(46):15617-15662.
Assis et al., 1998, "Synthesis of Chiral Epihalohydrins Using Haloalcohol Dehalogenase A from *Arthrobacter Erithii* H10a," *Enzyme Microb. Technol.* 22:545-551.
Hallinan et al., 1995, "Yeast Catalysed Reduction of β-keto Esters (2): Optimisation of the Stereospecific Reduction by *Zygosaccharomyces rouxii*," *Biocatal. Biotransform.* 12:179-191.
Kasai et al., 1998, "Chiral C3 Epoxides and Halohydrins: Their Preparation and Synthetic Application," *J. Molec. Cat. B: Enzymatic*, 4:237-252.
Lewis et al., 1999, "Cloning and Nucleotide Sequence of the Haloalcohol Dehalogenase B Gene from *Agrobacterium Tumefaciens*," Database Accession No. Q9WWB6, XP002152213.
Lutje Spelberg et al., 1998, "Enantioselectivity of a Recombinant Epoxide Hydrolase from *Agrobacterium Radiobacter*," *Tetrahedron: Asymmetry, Elsevier Science*, 9(3):459-466.
Lutje Spelberg et al., 1999, "A Tandem Enzyme Reaction to Produce Optically Active Halohydrins, Epoxides and Diols," *Tetrahedron: Asymmetry*, 10:2863-2870.
Lutje Spelberg et al., 2001, "Highly Enantioselective and Regioselective Biocatalytic Azidolysis of Aromatic Epoxides," *Org. Lett.*, 3(1):41-43.

(Continued)

*Primary Examiner*—Delia M Ramirez
*Assistant Examiner*—Younus Meah
(74) *Attorney, Agent, or Firm*—Dechert LLP

(57) ABSTRACT

The present invention relates to novel halohydrin dehalogenase polypeptides and the polynucleotides that encode them. These polypeptides are useful in the production of 4-substituted-3-butyric acid derivatives and vicinal cyano, hydroxyl substituted carboxylic acid esters. The invention also provides related vectors, host cells and methods.

8 Claims, 2 Drawing Sheets

OTHER PUBLICATIONS

Lutje Spelberg et al., 2002, "Exploration of the Biocatalytic Potential of a Halohydrin Dehalogenase using Chromogenic Substrates," *Tetrahedron: Asymmetry*, 13:1083-1089.

Mischitz et al., 1994 "Asymmetric Opening of an Epoxide by Azide Catalyzed by an Immobilized Enzyme Preparation from *Rhodococcus* sp.," Tetrahedron Letters, 35(1):81-84.

Nagasawa et al., 1992, "Purification and Characterization of Halohydrin Hydrogen-halide Lyase from a Recombinant *Escherichia coli* Containing the Gene from a *Corynebacterium* sp.," *Appl. Microbiol. Biotechnol.*, 36:478-482.

Nakamura et al., 1991, "A New Catalytic Function of Halohydrin Hydrogen-Halide-Lyase, Synthesis of β-Hydroxynitriles from Epoxides and Cyanide," *Biochem Biophys Res Commun.*, 180(1):124-30.

Nakamura et al., 1994, "A New Enzymatic Synthesis of (R)-γ-Chloro-β-Hydroxybutyronitrile," *Tetrahedron, Elsevier Science*, 50(41):11821-11826.

Nakamura, et al., 1994, "Characterization of a Novel Enantioselective Halohydrin Hydrogen-Halide-Lyase," *Appl. Environ. Microbiol.*, 60(4):1297-1301.

Office Action from U.S. Appl. No. 11/067,323 dated Aug. 8, 2007.
Office Action from U.S. Appl. No. 11/266,747 dated May 15, 2008.
Office Action from U.S. Appl. No. 11/266,747 dated Aug. 8, 2007.
PCT International Search Report from PCT/US06/05487 dated Sep. 25, 2008.
PCT International Search Report from PCT/US04/26654 dated Nov. 29, 2004.

Poelarends et al., 1999, "Degradation of 1,2-Dibromoethane by *Mycobacterium* sp. Strain GP1," *J. Bacteriol.*, 181(7):2050-2058.

Rink et al., 1997, "Primary Structure and Catalytic Mechanism of the Epoxide Hydrolase from *Agrobacterium Radiobacter* AD1," *J. Biol. Chem.*, 272(23):14650-14657.

SEQ ID No. 2 Comparison to Accession No. AAW69435 in JP1020981 A1.

Swanson, P. E., 1999, "Dehalogenases Applied to Industrial-Scale Biocatalysis," *Curr. Opin. Biotechnol.*, 10:365-369.

Van Den Wijngaard et al., 1991, "Purification and Characterization of Haloalcohol Dehalogenase from *Arthrobacter* sp. Strain AD2," *J. Bacteriol.*, 173(1):124-129.

Search Report from SG200808477-4 dated Jun. 3, 2010.

HALOHYDRIN DEHALOGENASES AND RELATED POLYNUCLEOTIDES

CROSS REFERENCE TO RELATED APPLICATIONS

This application claims priority under 35 U.S.C. §120 to U.S. provisional application Ser. No. 60/494,382, filed Aug. 11, 2003 and U.S. provisional application Ser. No. 60/546, 033, filed Feb. 18, 2004.

SEQUENCE LISTING SUBMISSION ON COMPACT DISC

The present application includes a Sequence Listing submitted on compact disc under 37 C.F.R. §§1.821(c) and 1.821 (e) and is incorporated herein by reference in its entirety. Four copies of the Sequence Listing, one on each of three compact discs (CDs) and one originally filed paper copy are provided. Originally filed Copies 1 and 2 on CD are identical to each other and to the originally filed paper copy and to the subsequently filed CRF on CD. Each electronic copy of the Sequence Listing was created on Aug. 11, 2004 with a file size of 2.13 MB. The file names are as follows: Copy 1—16028US03 ST25.txt; Copy 2—16028US03 ST25.txt; and CRF—16028US03 ST25.txt.

FIELD OF THE INVENTION

The present invention relates to novel halohydrin dehalogenase polypeptides and the polynucleotides that encode them.

BACKGROUND OF THE INVENTION

Halohydrin dehalogenase ("HHDH"), also named halohydrin hydrogen-halide-lyase or halohydrin epoxidase, [EC4.5.1] catalyzes the interconversion of 1,2-halohydrins and the corresponding 1,2-epoxides:

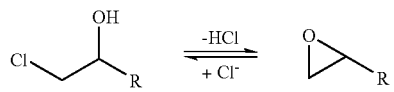

U.S. Pat. No. 4,284,723 describes the use of a halohydrin epoxidase for the production of propylene oxide. U.S. Pat. Nos. 5,166,061 and 5,210,031 describe the use of this enzyme activity for the conversion of 1,3-dichloropropanol (DCP) and epichlorohydrin (ECH) respectively to 4-chloro-3-hydroxybutyronitrile (CHBN). HHDH enzymes from *Agrobacterium radiobacter* and *Corynebacterium* have been characterized on a broad range of halogenated substrates (Van Hylckama Vlieg et al., *J. Bacteriol.* (2001) 183:5058-5066; Nakamura et al., *Appl. Environ. Microbiol.* (1994) 60:1297-1301; Nagasawa et al., *Appl. Microbiol. Biotechnol.* (1992) 36:478-482).

HHDH also catalyzes the ring opening of epoxides with nucleophiles other than chloride or bromide. It has been demonstrated that azide ($N_3^-$), nitrite ($NO_2^-$) and cyanide ($CN^-$) can replace chloride in the opening of epoxides (see Nakamura et al., *Biochem. Biophys Res. Comm.* (1991) 180:124-130; Nakamura et al., *Tetrahedron* (1994) 50: 11821-11826; Lutje Spelberg et al., *Org. Lett.* (2001) 3:41-43; Lutje Spelberg et al., *Tetrahedron Assym.* (2002) 13:1083):

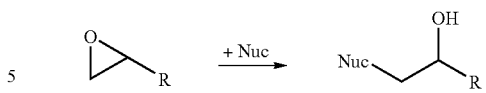

Nakamura et al. (*Tetrahedron* (1994) 50: 11821-11826) describe the use of HHDH for the direct conversion of DCP to chloro-3-hydroxy-butyronitrile (CHBN) through epichlorohydrin (ECH) as the intermediate:

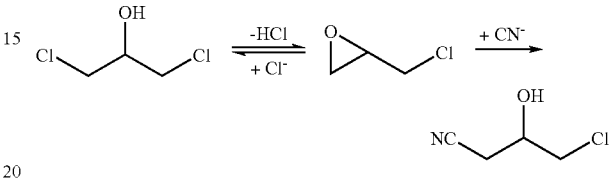

Some halohydrin dehalogenases have been characterized. For example, HHDH from *A. radiobacter* AD1 is a homotetramer of 28 kD subunits. *Corynebacterium* sp. N-1074 produces two HHDH enzymes, one of which is composed of 28 kD subunits (Ia), while the other is composed of related subunits of 35 and/or 32 kD (Ib). HHDH from some sources is easily inactivated under oxidizing conditions in a process that leads to dissociation of the subunits, has a pH optimum from pH 8 to 9 and an optimal temperature of 50° C (Tang, *Enz. Microbial Technol.* (2002) 30:251-258; Swanson, *Curr. Opin. Biotechnol.* (1999) 10:365-369). The optimal pH for HHDH catalyzed epoxide formation has been reported as 8.0 to 9.0 and the optimal temperature in the range of from 45° C. to 55° C. (Van Hylckama Vlieg et al., *J. Bacteriol.* (2001) 183:5058-5066; Nakamura et al., *Appl. Environ. Microbiol.* (1994) 60:1297-1301; Nagasawa et al., *Appl. Microbiol. Biotechnol.* (1992) 36:478-482). The optimal pH for the reverse reaction, ring opening by chloride, has been reported for the two *Corynebacterium* sp. N-1074 enzymes and is 7.4 (Ia) or 5 (Ib). Site directed mutagenesis studies on the *A. radiobacter* AD1 HHDH indicated that oxidative inactivation is due to disruption of the quartenary structure of the enzyme by oxidation of cysteine residues (Tang et al., *Enz. Microbial Technol.* (2002) 30:251-258).

Purified HHDH enzymes from different sources exhibit specific activities on DCP ranging from 146 U/mg (Ib) to 2.75 U/mg (Ia) (Nakamura et al., *Appl. Environ. Microbiol.* 1994 60:1297-1301; Nagasawa et al., *Appl. Microbiol. Biotechnol.* (1992) 36:478-482). The high activity of the Ib enzyme is accompanied by a high enantioselectivity to produce R-ECH from DCP, while the Ia enzyme produces racemic ECH.

HHDH encoding genes have been identified in *Agrobacterium radiobacter* AD1 (hheC), *Agrobacterium tumefaciens* (halB), *Corynebacterium* sp (hheA encoding Ia and hheB encoding Ib), *Arthrobacter* sp. (hheA$_{AD2}$), and *Mycobacterium* sp. GP1 (hheB$_{GP1}$). All enzymes have been functionally expressed in *E. coli*.

It is highly desirable for commercial applications of HHDH that the enzyme exhibits high volumetric productivity, that reactions run to completion in a relatively short period of time, with a high final product concentration, with high enanantioselectivity, and that no chemical side products are formed. These characteristics of a process can generally be used to define the broad characteristics of the enzyme: low Km for the substrate(s), high process stability, high specific activity, no substrate and product inhibition under conditions where chemical reactions are not proceeding. Currently available HHDH enzymes do not fulfill all of these criteria. For instance, the conversion on 1,2-epoxybutane and cyanide to 3-hydroxyvaleronitrile by HHDH proceeds at a maximum rate of 3 mmol/hr and this rate is sustained for only 10 minutes (Nakamura et al., *Biochem. Biophys Res. Comm.* (1991) 180: 124-130). Conversion of DCP and ECH to 4-chloro-3-hydroxybutyronitrile (CHBN) is also limited to rates of 2-3 mmol/hr (Nakamura, U.S. Pat. Nos. 5,166,061 and 5,210,031). An in depth analysis of the ECH to CHBN conversion reveals that while the hheB encoded HHDH-Ib enzyme has high activity, high productivity is maintained for only 20 min after which further conversion occurs at a rate that is at least 50-fold slower, with the overall conversion at just over 60% (Nakamura et al. *Tetrahedron* (1994) 50: 11821-11826). The direct conversion of DCP, via ECH to CHBN proceeds at a reduced rate and results in a 65.3% yield. Thus, HHDH as described in the literature does not meet the desired criteria for a catalyst in commercial applications.

Accordingly, new halohydrin dehalogenases would be highly desirable.

BRIEF SUMMARY OF THE INVENTION

The present invention is directed to a polypeptide, typically an isolated and optionally purified polypeptide (more typically, a recombinant polypeptide) having halohydrin dehalogenase activity, wherein the polypeptide comprises an amino acid sequence selected from the group consisting of:

(a) a polypeptide having an amino acid sequence that is at least 99% identical to SEQ ID NO: 4, 12, 16, 18, 34, 38, 44, 48, 52, 66, 80, 84, 114, 154, 158, 170, or 270;

(b) a polypeptide having an amino acid sequence that is at least 98% identical to SEQ ID NO: 10, 14, 68, 118, 164, 166, or 180;

(c) a polypeptide having an amino acid sequence that is at least 97% identical to SEQ ID NO: 110, 162, 262, 422, 440 or 520;

(d) a polypeptide having an amino acid sequence that is at least 96% identical to SEQ ID NO: 116 or 448;

(e) a polypeptide having an amino acid sequence that is at least 95% identical to SEQ ID NO: 264, 266, 470 or 476;

(f) a polypeptide having an amino acid sequence that is at least 93% identical to SEQ ID NO: 200;

(g) a polypeptide having an amino acid sequence that is at least 89% identical to SEQ ID NO: 442;

(h) a polypeptide having an amino acid sequence that is at least 88% identical to SEQ ID NO: 702;

(i) a polypeptide that is at least 80% identical to SEQ ID NO: 2, when optimally aligned with SEQ ID NO: 2, and which comprises at least one amino acid residue selected from the group consisting of T at (residue) position 2, A or P or S at position 3, V at position 4, D at position 6, either I or F at position 9, L at position 10, S at position 13, S at position 14, K at position 15, C at position 16, T or R at position 17, either C or S or K at position 20, T at position 24, Q at position 26, F at position 28, T at position 29, A at position 30, L at position 31, G at position 33, R at position 34, L at position 35, N at position 36, H at position 37, D at position 40, L at position 44, P at position 45, either P or A at position 47, N at position 52, V at position 54, R at position 55, D at position 56, K at position 58, G or D at position 61, V at position 63, R at position 72, I at position 75, P at position 76, C at position 78, Y at position 82, either S or L at position 84, A at position 85, E at position 91, D at position 93, Q or G at position 95, N at position 96, K at position 107, A at position 112, either T, S or G at position 114, A at position 115, P at position 117, N at position 120, E at position 121, P at position 122, R at position 126, V at position 130, S at position 133, A or V at position 134, L, W or V at position 136, H at position 139, I or R at position 142, S at position 144, S at position 146, T at position 152, S at position 153, either S or A at position 154, V at position 168, T at position 169, F at position 177, V at position 178, I at position 180, G or I at position 181, K at position 184, Y at position 186, L at position 194, N at position 198, M at position 199, E at position 215, G at position 236, V at position 237, L at position 238, T at position 240, either I or A or V at position 245, Y at position 249, V or I at position 252, and V at position 254;

(j) a polypeptide encoded by a nucleic acid that hybridizes under stringent conditions over substantially the entire length of a nucleic acid corresponding to SEQ ID NO: 1, and wherein the encoded polypeptide, when optimally aligned with SEQ ID NO: 2, comprises an amino acid sequence having at least one amino acid residue selected from the group consisting of T at (residue) position 2, A, P or S at position 3, V at position 4, D at position 6, either I or F at position 9, L at position 10, S at position 13, S at position 14, K at position 15, C at position 16, T or R at position 17, either S or K or C at position 20, T at position 24, Q at position 26, F at position 28, T at position 29, A at position 30, L at position 31, G at position 33, R at position 34, L at position 35, N at position 36, H at position 37, D at position 40, L at position 44, P at position 45, either P or A at position 47, N at position 52, V at position 54, R at position 55, D at position 56, K at position 58, G or D at position 61, V at position 63, R or Q at position 72, I at position 75, P at position 76, C at position 78, Y at position 82, either S or L at position 84, A at position 85, E at position 91, D at position 93, Q or G at position 95, N at position 96, G at position 99, K at position 107, A at position 112, either T, G or S at position 114, A at position 115, P at position 117, N at position 120, E at position 121, P at position 122, R at position 126, V at position 130, S at position 133, A or V at position 134, L, W or V at position 136, H at position 139, I or R at position 142, S at position 144, S at position 146, T at position 152, S at position 153, either S or A at position 154, V at position 168, T at position 169, F at position 177, V at position 178, I at position 180, G at position 181, K at position 184, Y at position 186, T at position 189, L at position 194, N at position 198, M at position 199, E at position 215, A at position 222, G at position 236, V at position 237, L at position 238, T at position 240, either I or A or V at position 245, V or I at position 252, and V at position 254.

In another aspect, the present invention is directed to a polypeptide, typically an isolated and optionally purified polypeptide (more typically, a recombinant polypeptide) having HHDH, wherein the polypeptide comprises an amino acid sequence selected from the group consisting of (a), (b), (c), (d), (e), (f), (g), (h), (i) and (j) as described above, and further comprises an amino acid residue selected from the group consisting of Q at position 37, Y at position 70, Q at position 72, Q at position 80, G at position 99, R at position 107, T at position 146, C at position 153, F at position 186, T at position 189, and A at position 222.

In another aspect, the present invention is directed to halohydrin dehalogenases (HHDH) having from 1.4 fold to 10,000 fold greater activity as compared to wild-type halohydrin dehalogenase from *Agrobacterium* sp. (SEQ ID NO: 2).

In a further aspect, the present invention is directed to an isolated or recombinant polypeptide having at least 1.4 fold greater HHDH activity as compared to wild-type HHDH having the amino acid sequence of SEQ ID NO: 2, and wherein the polypeptide is encoded by a nucleic acid that hybridizes under stringent conditions over substantially the entire length of a nucleic acid having a sequence selected from the group consisting of SEQ ID NO: 3, 9, 11, 13, 15, 17, 33, 37, 43, 47, 49, 51, 65, 67, 79, 83, 109, 113, 115, 117, 153, 157, 161, 163, 165, 169, 179,161, 199, 261, 263, 265, 269, 421, 439, 441, 447, 469, 475, 519, 701, 725, 729, 731, 733, 735, 737, and complementary sequences thereof.

In another aspect, the present invention is directed to HHDH polynucleotides that encode polypeptides having halohydrin dehalogenase activity.

In a still further aspect, the present invention is directed to a vector comprising an HHDH polynucleotide of the present invention operatively linked to a promoter.

In other embodiments, the present invention is directed to host cells and methods for producing HHDH polypeptides of the present invention from such host cells.

DETAILED DESCRIPTION

HHDH Polypeptides

Figure 1:
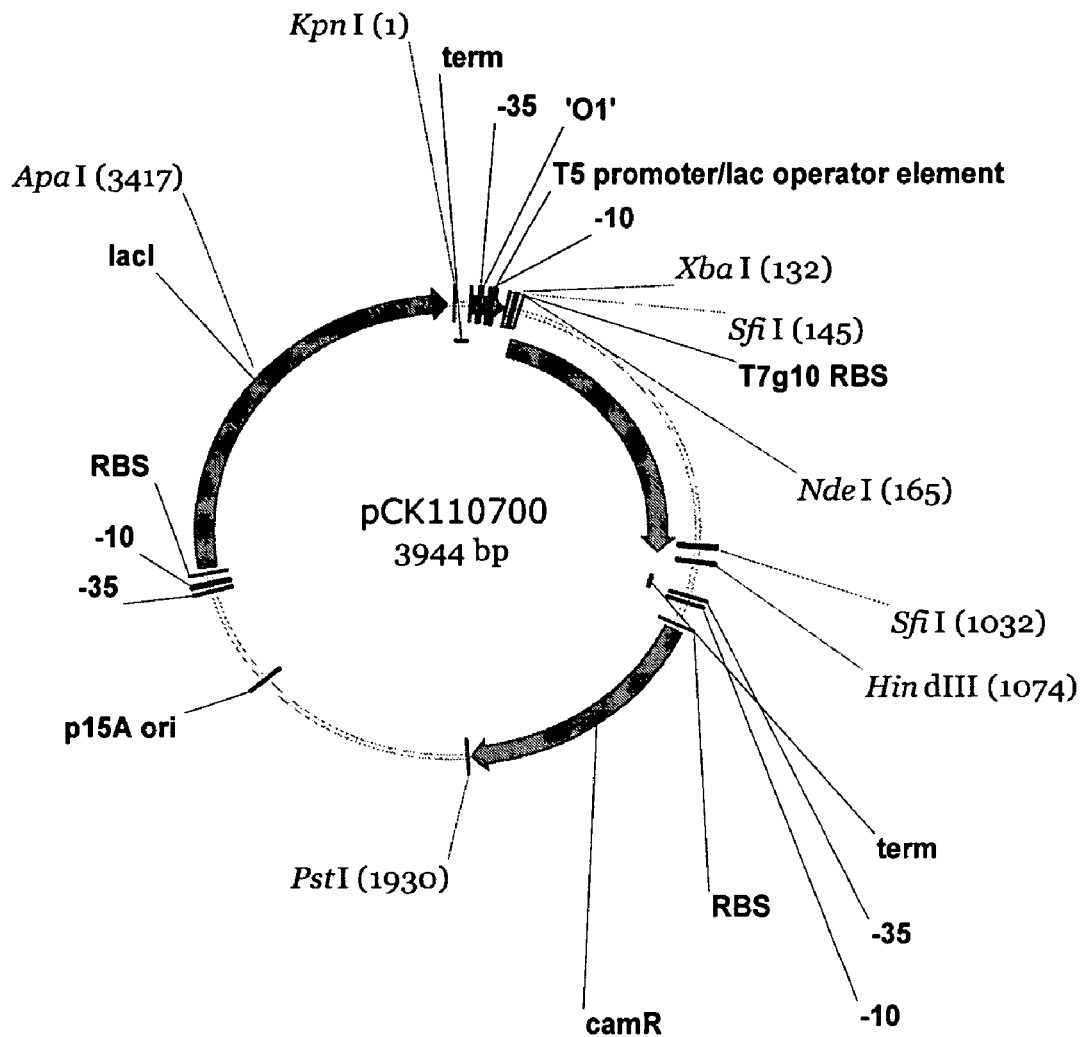
FIG. 1 is a 3944 bp expression vector (PCK110700) of the present invention comprising a p15A origin of replication (P15A ori), a lacI repressor, a T5 promoter, a T7 ribosomal binding site (T7g10), and a chloramphenicol resistance gene (camR).

The present invention provides novel polypeptides having halohydrin dehalogenase ("HHDH") activity, as well as the polynucleotides that encode them. The HHDH polypeptides of the present invention are suitable for catalyzing the conversion of 4-halo-3-hydroxybutyric acid derivatives to 4-substituted-3-hydroxybutyric acid derivatives, using, for example, the methods described in the patent application entitled, "Enzymatic Processes for the Production of 4-Substituted-3-Hydroxybutyric Acid Derivatives," corresponding to Attorney Docket No. 0339.210US, filed on Aug. 11, 2003 and assigned U.S. Ser. No. 10/639,159, which is hereby incorporated herein by reference. These invention polypeptides are also suitable for catalyzing the conversion of vicinal halo, hydroxy substituted carboxylic acid esters to vicinal cyano, hydroxy substituted carboxylic acid esters using, for example the methods described in the patent application entitled, "Enzymatic Processes for the Production of 4-Substituted-3-Hydroxybutyric Acid Derivatives and Vicinal Cyano, Hydroxy Substituted Carboxylic Acid Esters," corresponding to, filed on Feb. 18, 2004 and assigned U.S. Ser. No. 10/782,258, which is hereby incorporated by reference. Polypeptides of the present invention are particularly useful as catalysts for converting halohydrins to cyanohydrins, which are useful as pharmaceutical intermediates. In a specific application, HHDH polypeptides of the present invention are used to catalyze the conversion of ethyl-4-chloro-3-hydroxybutyrate to ethyl-4-cyano-3-hydroxybutyrate. Examples illustrating such conversion are provided hereinbelow. A more detailed description of such uses is provided in the aforementioned patent applications entitled, "Enzymatic Processes for the Production of 4-Substituted-3-Hydroxybutyric Acid Derivatives" and "Enzymatic Processes for the Production of 4-Substituted-3-Hydroxybutyric Acid Derivatives and Vicinal Cyano, Hydroxy Substituted Carboxylic Acid Esters." Id.

The present invention provides an isolated or recombinant polypeptide having HHDH activity, wherein the HHDH polypeptide comprises an amino acid sequence selected from the group consisting of: a polypeptide having an amino acid sequence that is at least 99% identical to SEQ ID NO: 4, 12, 16, 18, 34, 38, 44, 48, 52, 66 80, 84, 114, 154, 158, 170, or 270.

As used herein, the terms "HHDH activity" and "halohydrin dehalogenase activity" are used interchangeably herein to refer to the ability to catalyze the conversion of ethyl (S)-4-chloro-3-hydroxybutyrate ("ECHB") to a detectable amount of ethyl (R) 4-cyano-3-hydroxybutyrate ("HN") using the assay described in Example 5A. The term "HHDH polypeptide" refers herein to a polypeptide having HHDH activity. The term "HHDH polynucleotide" refers to a polynucleotide encoding a polypeptide having HHDH activity.

As used herein, the term "isolated" refers to a nucleic acid, polynucleotide, polypeptide, protein, or other component that is partially or completely separated from components with which it is normally associated (other proteins, nucleic acids, cells, synthetic reagents, etc.). A nucleic acid or polypeptide is "recombinant" when it is artificial or engineered, or derived from an artificial or engineered protein or nucleic acid. For example, a polynucleotide that is inserted into a vector or any other heterologous location, e.g., in a genome of a recombinant organism, such that it is not associated with nucleotide sequences that normally flank the polynucleotide as it is found in nature is a recombinant polynucleotide. A protein expressed in vitro or in vivo from a recombinant polynucleotide is an example of a recombinant polypeptide. Likewise, a polynucleotide sequence that does not appear in nature, for example a variant of a naturally occurring gene, is recombinant.

The terms "percent identity," "% identity," "percent identical," and "% identical" are used interchangeably herein to refer to the percent amino acid sequence identity that is obtained by ClustalW analysis (version W 1.8 available from European Bioinformatics Institute, Cambridge, UK), counting the number of identical matches in the alignment and dividing such number of identical matches by the length of the reference sequence, and using the following default ClustalW parameters to achieve slow/accurate pairwise optimal alignments—Gap Open Penalty: 10; Gap Extension Penalty: 0.10; Protein weight matrix: Gonnet series; DNA weight matrix: IUB; Toggle Slow/Fast pairwise alignments=SLOW or FULL Alignment.

The present invention also provides a polypeptide having an amino acid sequence that is at least 98% identical to SEQ ID NO: 10, 14, 68, 118, 164, 166, or 180. Desirable HHDH polypeptides include those that are at least 99% identical to SEQ ID NO: 10, 14, 68, 118, 164, 166, or 180.

In another embodiment, the present invention provides a polypeptide having an amino acid sequence that is at least 97% identical to SEQ ID NO: 110, 162, 262, 422, 440, or 520. Some HHDH polypeptides of the present invention are at least 98%, and sometimes at least 99% identical to SEQ ID NO: 110, 162, 262 422, 440, or 520.

In yet another embodiment, the present invention is directed to a polypeptide, typically an isolated and purified polypeptide having HHDH activity greater than the wild-type HHDH of SEQ ID NO: 2, and having an amino acid sequence that is at least 93% identical to SEQ ID NO: 200, typically, 95% identical to SEQ ID NO: 200; more typically, 97% identical to SEQ ID NO: 200; most typically, 99% identical to SEQ ID NO: 200.

In still another embodiment, the present invention is directed to a polypeptide, typically an isolated and purified polypeptide having HHDH activity greater than the wild-type HHDH of SEQ ID NO. 2, and having an amino acid sequence that is at least 89% identical to SEQ ID NO: 442; typically, 93% identical to SEQ ID NO: 442; more typically, 95% identical to SEQ ID NO: 442; even more typically, 97% identical to SEQ ID NO: 442; most typically, 99% identical to SEQ ID NO: 442.

In another embodiment, the present invention is directed to a polypeptide, typically an isolated and purified polypeptide having HHDH activity greater than the wild-type HHDH of SEQ ID NO. 2, and having an amino acid sequence that is at least 88% identical to SEQ ID NO: 702; typically, 93% identical to SEQ ID NO: 702: more typically, 95% identical to SEQ ID NO: 702; even more typically, 97% identical to SEQ ID NO: 702; most typically, 99% identical to SEQ ID NO: 702.

In a further embodiment, the present invention provides an HHDH polypeptide having an amino acid sequence that is at least 96% identical to SEQ ID NO: 116 or 448. HHDH polypeptides of the present invention include those that are least 97% identical, 98% identical, and 99% identical to SEQ ID NO: 116 or 448.

The present invention further provides an HHDH polypeptide having an amino acid sequence that is at least 95% identical to SEQ ID NO: 264, 266, 470 or 476. Desirable HHDH polypeptides of the present invention include those that are least 96% identical, 97% identical, 98% identical, and 99% identical to SEQ ID NO: 264, 266, 470 or 476.

The present invention further provides an HHDH polypeptide that is at least 80% identical to SEQ ID NO: 2, when optimally aligned with SEQ ID NO:2, and which further has one or more substitutions selected from the group consisting of S2T, either T3A or T3P, A4V, V6D, either V9I or V9F, K10L, G13S, G14S, M15K, G16C, either S17T or S17R, either R20S, R20C or R20K, A24T, H26Q, V28F, A29T, C30A, H31L, E33G, S34R, F35L, K36N, Q37H, E40D, F44L, A45P, either T47P or T47A, K52N, M54V, S55R, E56D, E58K, either E61G or E61D, I63V, Q72R, V75I, L76P, S78C, F82Y, either P84S or P84L, E85Q, K91E, A93D, E95Q or E95G, D96N, R107K, V112A, either A114T or A114G or A114S, V115A, S117P, K120N, K121E, R122P, H126R, I130V, A133S, T134A or T134V, F136L or F136W or F136V, W139H, L142I or L142R, T144S, T146S, A152T, C153S, either T154S or T154A, I168V, P169T, Y177F, L178V, S180I, E181G or E181I, P184K, F186Y, T194I, H198N, V199M, K215E, V236G, F237V, W238L, A240T, either M245I or M245A or M245V, W249Y, M252V or M252I, and E254V. In some embodiments, HHDH polypeptides of the present invention are at least 85% identical to SEQ ID NO: 2 and having one or more of the substitutions indicated above. Some HHDH polypeptides of the present invention are at least about 90% identical to SEQ ID NO: 2, some are at least about 95% identical to SEQ ID NO: 2, and others are at least 99% identical to SEQ ID NO: 2, all having one or more of the substitutions indicated above. Some of these HHDH polypeptides have at least 2 or more of the aforementioned substitutions, and some of these HHDH polypeptides have at least 3 or more of the aforementioned substitutions.

When optimally aligned with sequence SEQ ID NO: 2, certain HHDH polypeptides of the present invention have a sequence corresponding to SEQ ID NO: 2, but one or more amino acid substitutions selected from the group consisting of S2T, either T3A or T3P, A4V, V6D, either V9I or V9F, K10L, G13S, G14S, M15K, G16C, either S17T or S17R, either R20S, R20C or R20K, A24T, H26Q, V28F, A29T, C30A, H31L, E33G, S34R, F35L, K36N, Q37H, E40D, F44L, A45P, either T47P or T47A, K52N, M54V, S55R, E56D, E58K, either E61G or E61D, I63V, Q72R, V75I, L76P, S78C, F82Y, either P84S or P84L, E85Q, K91E, A93D, E95Q or E95G, D96N, R107K, V112A, either A114T or A114G or A114S, V115A, S117P, K120N, K121E, R122P, H126R, I130V, A133S, T134A or T134V, F136L or F136W or F136V, W139H, L142I or L142R, T144S, T146S, A152T, C153S, either TI54S or T154A, I168V, P169T, Y177F, L178V, S180I, E181G or E181I, P184K, F186Y, T194I, H198N, V199M, K215E, V236G, F237V, W238L, A240T, either M245I or M245A or M245V, W249Y, M252V or M252I, and E254V. In some embodiments, the HHDH polypeptides have two or more, and sometimes three or four or more of the aforementioned substitutions. Typically, in this embodiment, the resulting HHDH polypeptide has at least 80% of sequence identity with SEQ ID NO: 2; more typically, at least 90% sequence identity; even more typically at least 95% sequence identity; and yet even more typically at least 98% sequence identity.

The HHDH polypeptides described herein may further have one or more amino acid residues selected from the group consisting of Q at position 37, Y at position 70, Q at position 72, Q at position 80, G at position 99, R at position 107, T at position 146, C at position 153, F at position 186, T at position 189, and A at position 222. In some embodiments, the HHDH polypeptides of the present invention have two, three, or four or more of these selected residues. Of these residues, Q37, Y70, Q87, R107, T146, C153, and F186 appear to correlate favorably with HHDH activity. Others appear to correlate favorably well with resistance to inhibition by ethyl-4-chloroacetate, as discussed in more detail below.

Two sequences are "optimally aligned" when they are aligned for similarity scoring using a defined amino acid substitution matrix (e.g., BLOSUM62), gap existence penalty and gap extension penalty so as to arrive at the highest core possible for that pair of sequences. Amino acid substitution matrices and their use in quantifying the similarity between two sequences are well-known in the art. See e.g., Dayhoff et al. (1978), "A model of evolutionary change in proteins"; "Atlas of Protein Sequence and Structure," Vol. 5, Suppl. 3 (Ed. M. O. Dayhoff), pp.345-352, *Natl. Biomed. Res. Round.*, Washington, D.C.; Henikoff et al. (1992) *Proc. Natl. Acad. Sci. USA,* 89:10915-10919. The BLOSUM62 matrix is often used as a default scoring substitution matrix in sequence alignment protocols such as Gapped BLAST 2.0. The gap existence penalty is imposed for the introduction of a single amino acid gap in one of the aligned sequences, and the gap extension penalty is imposed for each additional empty amino acid position inserted into an already opened gap. The alignment is defined by the amino acids position of each sequence at which the alignment begins and ends, and optionally by the insertion of a gap or multiple gaps in one or both sequences so as to arrive at the highest possible score. While optimal alignment and scoring can be accomplished manually, the process is facilitated by the use of a computer-implemented alignment algorithm, e.g., gapped BLAST 2.0, described in Altschul, et al. (1997) *Nucleic Acids Res.,* 25:3389-3402, and made available to the public at the National Center for Biotechnology Information Website. Optimal alignments, including multiple alignments can be prepared using readily available programs such as PSI-BLAST, which is described by Altschul, et al. (1997) *Nucleic Acids Res.,* 25:3389-3402.

With respect to an amino acid sequence that is optimally aligned with a reference sequence, an amino acid residue "corresponds to" the position in the reference sequence with which the residue is paired in the alignment. The "position" is denoted by a number that sequentially identifies each amino acid in the reference sequence based on its position relative to the N-terminus. Owing to deletions, insertions, truncations, fusions, and the like that must be taken into account when determining an optimal alignment, in general the amino acid residue number in a test sequence is determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

In a further embodiment, the present invention provides an HHDH polypeptide that is at least 93% identical to SEQ ID NO: 200 (i.e., 18 or fewer amino acid differences as compared to SEQ ID NO: 200, when optimally aligned with SEQ ID NO: 200). Some of these HHDH polypeptides are at least 95% identical to SEQ ID NO: 200, and some are at least 97, 98, or 99% identical to SEQ ID NO: 200. In certain embodiments, these polypeptides have one or more of the following residues: T at (residue) position 2, A or P or S at position 3, V at position 4, D at position 6, either I or F at position 9, L at position 10, S at position 13, S at position 14, K at position 15, C at position 16, T or R at position 17, either C or S or K at position 20, T at position 24, Q at position 26, F at position 28, T at position 29, A at position 30, L at position 31, G at position 33, R at position 34, L at position 35, N at position 36, H at position 37, D at position 40, L at position 44, P at position 45, either P or A at position 47, N at position 52, V at position 54, R at position 55, D at position 56, K at position 58, G or D at position 61, V at position 63, R at position 72, I at position 75, P at position 76, C at position 78, Y at position 82, either S or L at position 84, A at position 85, E at position 91, D at position 93, Q or G at position 95, N at position 96, K at position 107, A at position 112, either T, S or G at position 114, A at position 115, P at position 117, N at position 120, E at position 121, P at position 122, R at position 126, V at position 130, S at position 133, A or V at position 134, L, W or V at position 136, H at position 139, I or R at position 142, S at position 144, S at position 146, T at position 152, S at position 153, either S or A at position 154, V at position 168, T at position 169, F at position 177, V at position 178, I at position 180, G or I at position 181, K at position 184, Y at position 186, L at position 194, N at position 198, M at position 199, E at position 215, G at position 236, V at position 237, L at position 238, T at position 240, either I or A or V at position 245, Y at position 249, V or I at position 252, and V at position 254.

The present invention also provides HHDH polypeptides encoded by a nucleic acid that hybridizes under stringent conditions over substantially the entire length of a nucleic acid corresponding to SEQ ID NO: 1, where the encoded polypeptide, when optimally aligned with SEQ ID NO: 2, comprises an amino acid sequence having at least one amino acid residue selected from the group consisting of T at (residue) position 2, A or P or S at position 3, V at position 4, D at position 6, either I or F at position 9, L at position 10, S at position 13, S at position 14, K at position 15, C at position 16, T or R at position 17, either S or K at position 20, T at position 24, Q at position 26, F at position 28, T at position 29, A at position 30, L at position 31, G at position 33, R at position 34, L at position 35, N at position 36, H at position 37, D at position 40, L at position 44, P at position 45, either P or A at position 47, N at position 52, V at position 54, R at position 55, D at position 56, G or D at position 61, V at position 63, R or Q at position 72, I at position 75, P at position 76, C at position 78, Y at position 82, either S or L at position 84, A at position 85, E at position 91, D at position 93, Q or G at position 95, N at position 96, G at position 99, K at position 107, A at position 112, either T, S or G at position 114, A at position 115, P at position 117, N at position 120, E at position 121, P at position 122, R at position 126, V at position 130, S at position 133, A or V at position 134, L, W or V at position 136, H at position 139, I or R at position 142, S at position 144, S at position 146, T at position 152, S at position 153, either S or A at position 154, V at position 168, T at position 169, F at position 177, V at position 178, I at position 180, G or I at position 181, K at position 184, Y at position 186, T at position 189, L at position 194, N at position 198, M at position 199, E at position 215, A at position 222, G at position 236, V at position 237, L at position 238, T at position 240, either I or A or V at position 245, Y at position 249, V or I at position 252, and V at position 254.

The present invention also provides an isolated or recombinant polypeptide having at least 1.4 fold greater HHDH activity as compared to wild-type HHDH having the amino acid sequence of SEQ ID NO: 2, and wherein the polypeptide is encoded by a nucleic acid that hybridizes under stringent conditions over substantially the entire length of a nucleic acid having a sequence selected from the group consisting of SEQ ID NO: 3, 9, 11, 13, 15, 17, 33, 37, 43, 47, 49, 51, 65, 67, 79, 83, 109, 113, 115, 117, 153, 157, 161, 163, 165, 169, 179, 161, 199, 261, 263, 265, 269, 421, 439, 441, 447, 469, 475, 519, 701, 725, 729, 731, 733, 735, 737, and complementary sequences thereof.

Nucleic acids "hybridize" when they associate, typically in solution. Nucleic acids hybridize due to a variety of well-characterized physico-chemical forces, such as hydrogen bonding, solvent exclusion, base stacking and the like. An extensive guide to the hybridization of nucleic acids is found in Tijssen (1993) "Laboratory Techniques in biochemistry and Molecular Biology-Hybridization with Nucleic Acid Probes," Part I, Chapter 2 (Elsevier, N.Y.).

As used herein, the term "stringent hybridization wash conditions" in the context of nucleic acid hybridization experiments, such as Southern and Northern hybridizations, are sequence dependent, and are different under different environmental parameters. An extensive guide to the hybridization of nucleic acids is found in Tijessen (1993) "Laboratory Techniques in Biochemistry and Molecular Biology-Hybridization with Nucleic Acid Probes," Part I, Chapter 2 (Elsevier, N.Y.).

For purposes of the present invention, "highly stringent" (or "high stringency") hybridization and wash conditions are generally selected to be about 5° C. or less lower than the thermal melting point ($T_m$) for the specific sequence at a defined ionic strength and pH (as noted below, highly stringent conditions can also be referred to in comparative terms). The $T_m$ is the temperature (under defined ionic strength and pH) at which 50% of the test sequence hybridizes to a perfectly matched probe. Very stringent conditions are selected to be equal to the $T_m$ for a particular probe.

The $T_m$ of a nucleic acid duplex indicates the temperature at which the duplex is 50% denatured under the given conditions and it represents a direct measure of the stability of the nucleic acid hybrid. Thus, the $T_m$ corresponds to the temperature corresponding to the midpoint in transition from helix to random coil; it depends on length, nucleotide composition, and ionic strength for long stretches of nucleotides.

After hybridization, unhybridized nucleic acid material can be removed by a series of washes, the stringency of which can be adjusted depending upon the desired results. Low stringency washing conditions (e.g., using higher salt and lower temperature) increase sensitivity, but can produce non-specific hybridization signals and high background signals (i.e., loses specificity). Higher stringency conditions (e.g., using lower salt and higher temperature that is closer to the hybridization temperature) lowers the background signal, typically with only the specific signal remaining (i.e., increases specificity). See Rapley, R. and Walker, J. M. Eds., "Molecular Biomethods Handbook" (Humana Press, Inc. 1998).

The $T_m$ of a DNA-DNA duplex can be estimated using Equation 1 as follows:

$$T_m(° C.)=81.5° C.+16.6(\log_{10} M)+0.41(\% G+C)-0.72(\% f)-500/n,$$

where M is the molarity of the monovalent cations (usually Na+), (% G+C) is the percentage of guanosine (G) and cystosine (C) nucleotides, (% f) is the percentage of formamide and n is the number of nucleotide bases (i.e., length) of the hybrid. See id.

The $T_m$ of an RNA-DNA duplex can be estimated by using Equation 2 as follows:

$$T_m(° C.)=79.8° C.+18.5(\log_{10} M)+0.58(\% G+C)-11.8(\% G+C)^2-0.56(\% f)-820/n,$$

where M is the molarity of the monovalent cations (usually $Na^+$), (% G+C) is the percentage of guanosine (G) and cystosine (C) nucleotides, (% f) is the percentage of formamide and n is the number of nucleotide bases (i.e., length) of the hybrid. Id.

Equations 1 and 2 are typically accurate only for hybrid duplexes longer than about 100-200 nucleotides. Id.

The $T_m$ of nucleic acid sequences shorter than 50 nucleotides can be calculated as follows:

$$T_m(° C.)=4(G+C)+2(A+T),$$

where A (adenine), C, T (thymine), and G are the numbers of the corresponding nucleotides.

An example of stringent hybridization conditions for hybridization of complementary nucleic acids which have more than 100 complementary residues on a filter in a Southern or northern blot is 50% formamide with 1 mg of heparin at 42° C., with the hybridization being carried out overnight. An example of stringent wash conditions is a 0.2×SSC wash at 65° C. for 15 minutes (see Sambrook, et al., Molecular Cloning—A Laboratory Manual" (1989) Cold Spring Harbor Laboratory (Cold Spring Harbor, N.Y.) for a description of SSC buffer). Often the high stringency wash is preceded by a low stringency wash to remove background probe signal. An example low stringency wash is 2× SSC at 40° C. for 15 minutes.

In general, a signal to noise ratio of 2.5×-5× (or higher) than that observed for an unrelated probe in the particular hybridization assay indicates detection of a specific hybridization. Detection of at least stringent hybridization between two sequences in the context of the present invention indicates relatively strong structural similarity or homology to, e.g., the nucleic acids of the present invention provided in the sequence listings herein.

As noted, "highly stringent" conditions are selected to be about 5° C. or less lower than the thermal melting point ($T_m$) for the specific sequence at a defined ionic strength and pH. Target sequences that are closely related or identical to the nucleotide sequence of interest (e.g., "probe") can be identified under highly stringent conditions. Lower stringency conditions are appropriate for sequences that are less complementary.

Stringent hybridization (as well as highly stringent, ultra-high stringency, or ultra-ultra high stringency hybridization conditions) and wash conditions can be readily determined empirically for any test nucleic acid. For example, in determining highly stringent hybridization and wash conditions, the hybridization and wash conditions are gradually increased (e.g., by increasing temperature, decreasing salt concentration, increasing detergent concentration and/or increasing the concentration of organic solvents, such as formamide, in the hybridization or wash), until a selected set of criteria are met. For example, the stringency of hybridization and wash conditions are gradually increased until a probe corresponding to SEQ ID NO: 3, 9, 11, 13, 15, 17, 33, 37, 43, 47, 49, 51, 65, 67, 79, 83, 109, 113, 115, 117, 153, 157, 161, 163, 165, 169, 179, 161, 199, 261, 263, 265, 269, 421, 439, 441, 447, 469, 475, 519, 701 or complementary sequence thereof, binds to a perfectly matched complementary target. A test nucleic acid is said to specifically hybridize to a probe nucleic acid when it hybridizes at least ½ as well to the probe as to the perfectly matched complementary target, i.e., with a signal to noise ratio at least ½ as high as hybridization of the probe to the target under conditions in which the perfectly matched probe binds to the perfectly matched complementary target.

Ultra high-stringency hybridization and wash conditions are those in which the stringency of hybridization and wash conditions are increased until the signal to noise ratio for binding of the probe to the perfectly matched complementary target nucleic acid is at least 10×. A target nucleic acid which hybridizes to a probe under such conditions, with a signal to noise ratio of at least ½ that of the perfectly matched complementary target nucleic acid is said to bind to the probe under ultra-high stringency conditions.

Similarly, even higher levels of stringency can be determined by gradually increasing the stringency of hybridization and/or wash conditions of the relevant hybridization assay. For example, those in which the stringency of hybridization and wash conditions are increased until the signal to noise ratio for binding of the probe to the perfectly matched complementary target nucleic acid is at least 10×, 20×, 50×, 100×, or 500×. A target nucleic acid which hybridizes to a probe under such conditions, with a signal to noise ratio of at least ½ that of the perfectly matched complementary target nucleic acid is said to bind to the probe under ultra-ultra-high stringency conditions.

Specific HHDH polypeptides of the present invention include those having an amino acid sequence corresponding to SEQ ID NOS: 4, 6, 8, 10, 12, 14, 16, 18, 20, 22, 24, 26, 28, 30, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258. 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742 or 744. All of these HHDH polypeptides have demonstrated activity in the assays described in Example 5A or 5B.

Exemplary HHDH polynucleotides that encode these HHDH polypeptides are provided herein as SEQ ID NOS: 3, 5, 7, 9, 11, 13, 15, 17, 19, 21, 23, 25, 27, 29, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 4712, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 739, 741, and 743 respectively.

HHDH polypeptides of the present invention often have HHDH activity that is at least 1.4 fold greater HHDH activity as compared to wild-type HHDH having the amino acid sequence of SEQ ID NO: 2, as measured in the assay described in Example 5A. Some HHDH polypeptides of the present invention (SEQ ID NOS: 740, 742, 728, 90, 92, 94, 96 and 96) have HHDH enzyme activity that is at least 2 fold and often at least 2.4 fold up to 100 fold greater than the activity of Agrobacterium sp. HHDH (SEQ ID NO: 2); the HHDH polypeptides of SEQ ID NOS: 100, 732, 734 and 736 have HHDH enzyme activity that is from 100 to 500 fold greater than the activity of Agrobacterium sp. HHDH (SEQ ID NO: 2); and the HHDH polypeptides of SEQ ID NOS: 726 and 730 have HHDH enzyme activity that is 500 to 1000 times greater than the activity of Agrobacterium sp. HHDH (SEQ ID NO: 2), the enzyme activities being measured in the assay described in Example 5A.

The present invention also provides HHDH polypeptides that are variants of the polypeptide of SEQ ID NO: 4, 6, 8, 10, 12, 14, 16, 18, 20, 22, 24, 26, 28, 30, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740 or 742 having a substitution, deletion, and/or insertion of one to six amino acid residues.

Variants of the HHDH polypeptides of the present invention may be generated using methods that are well known to those having ordinary skill in the art. Libraries of these variants may be generated and screened using the high throughput screen for presence of HHDH activity described in Example 4A. In some instances it may be desirable to identify halohydrin dehalogenases that exhibit activity in the presence of cyanohydrin product inhibitor, e.g., ethyl (R)-4-cyano-3-hydroxybutyrate. A high throughput screen for identifying such enzymes is provided in Example 4B.

Each of the residue changes to an HHDH polypeptide was evaluated to determine what relationship, if any, existed between the sequence change and the desired function (increased HHDH enzymatic activity). To do so, the sequence changes and resulting enzyme activity in members of a library generated by the method described in WO 00/42561 were evaluated using the method disclosed in U.S. Ser. No. 10/379, 378 filed Mar. 3, 2003, entitled "Methods, systems, and software for identifying functional biomolecules" and incorporated herein by reference. Based upon this method, codons encoding important residues at certain positions that appear to correlate favorably to activity were identified and incorporated into the polynucleotides of a subsequently generated combinatorial library. In other words, the polynucleotides encoding the desired change were generated, expressed and then screened. The method is again applied to the resulting sequences and the enzymatic activity of the hits. The results are again utilized to select those residue changes that enhance enzyme activity for programming into the next library. Using this method, the functionality of various sequence changes (and although not characterized, potential structural changes as well) is subject to immediate evaluation. The residue changes at various residue positions that provide for enhanced enzymatic activity relative to the wild-type HHDH are disclosed herein in the sequences and elsewhere as preferred residues at identified positions.

Those variants exhibiting the presence of HHDH activity can be further characterized in the quantitative HHDH assay described in Example 5A. Variants that exhibit HHDH activity in the presence of product cyanohydrin, e.g., ethyl (R) 4-cyano-3-hydroxybutyrate, may be further characterized using the assay described in Example 5B. Example 5B describes a protocol for assaying for enzymes that are robust with respect to product inhibition. Thus, variant libraries may be readily screened and assayed to identify HHDH polypeptides that are active under conditions that mimic actual process conditions. The present invention provides HHDH polypeptides that exhibit significant activity even in the presence of product, ethyl (R)-4-cyano-3-hydroxybutyrate in the assay described in Example 5B (e.g., SEQ ID NOS: 98, 100, 102, 104, 106, 108, 120, 122, 124, 126, 128, 130, 132, 136, 138, 140, 142, 144, 146, 148, 150, 152, 160, 174, 176, 178, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 276, 278, 280, 282, 284, 286, 288, 290, 292, 294, 296, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740 or 742. Polypeptides that exhibit the ability to convert ethyl (S)-4-chloro-3-hydroxybutyrate to ethyl (R)-4-cyano-3-hydroxybutyrate in the assay of Example 5B, would also demonstrate HHDH activity in the assay of Example 5A.

Methods for generating variant libraries are well known in the art. For example, mutagenesis and directed evolution methods can be readily applied to polynucleotides (such as, for example, wild-type HHDH encoding polynucleotides or the polynucleotides of the present invention) to generate variant libraries that can be expressed, screened, and assayed using the methods described herein. Mutagenesis and directed evolution methods are well known in the art. See, e.g., Ling, et al., "Approaches to DNA mutagenesis: an overview," *Anal. Biochem.*, 254(2): 157-78 (1997); Dale, et al., "Oligonucleotide-directed random mutagenesis using the phosphorothioate method," *Methods Mol. Biol.*, 57:369-74 (1996); Smith, "In vitro mutagenesis," *Ann. Rev. Genet.*, 19:423-462 (1985); Botstein, et al., "Strategies and applications of in vitro mutagenesis," *Science*, 229:1193-1201 (1985); Carter, "Site-directed mutagenesis," *Biochem. J.*, 237:1-7 (1986); Kramer, et al., "Point Mismatch Repair," *Cell*, 38:879-887 (1984); Wells, et al., "Cassette mutagenesis: an efficient method for generation of multiple mutations at defined sites," *Gene*, 34:315-323 (1985); Minshull, et al., "Protein evolution by molecular breeding," *Current Opinion in Chemical Biology*, 3:284-290 (1999); Christians, et al., "Directed evolution of thymidine kinase for AZT phosphorylation using DNA family shuffling," *Nature Biotechnology*, 17:259-264 (1999); Crameri, et al., "DNA shuffling of a family of genes from diverse species accelerates directed evolution," *Nature*, 391:288-291; Crameri, et al., "Molecular evolution of an arsenate detoxification pathway by DNA shuffling," *Nature Biotechnology*, 15:436-438 (1997); Zhang, et al., "Directed evolution of an effective fucosidase from a galactosidase by DNA shuffling and screening," *Proceedings of the National Academy of Sciencess, U.S.A.*, 94:454-4509; Crameri, et al., "Improved green fluorescent protein by molecular evolution using DNA shuffling," *Nature Biotechnology*. 14:315-319 (1996); Stemmer, "Rapid evolution of a protein in vitro by DNA shuffling," *Nature*, 370:389-391 (1994); Stemmer, "DNA shuffling by random fragmentation and reassembly: In vitro recombination for molecular evolution," *Proceedings of the National Academy of Sciences. U.S.A.*, 91:10747-10751 (1994); WO 95/22625; WO 97/0078; WO 97/35966; WO 98/27230; WO 00/42651; and WO 01/75767.

In another embodiment, the present invention also provides a fragment of the HHDH polypeptides described herein having HHDH activity that is at least 1.4 fold greater than the activity of *Agrobacterium* sp. (wild-type) HHDH (SEQ ID NO: 2) in the assay of Example 5A. As used herein, the term "fragment" refers to a polypeptide having a deletion of from 1 to 5 amino acid residues from the carboxy terminus, the amino terminus, or both. Preferably, the deletion is from 1 to 5 residues from the carboxy terminus.

HHDH Polynucleotides

The present invention provides polynucleotides that encode HHDH polypeptides of the present invention. In a specific embodiment of the present invention, HHDH polynucleotides comprise a nucleic acid that hybridizes under stringent conditions over substantially the entire length of a nucleic acid corresponding to SEQ ID NO: 1, where the polypeptide encoded by the HHDH polynucleotide comprises an amino acid sequence having at least one amino acid residue selected from the group consisting of T at (residue) position 2, A or P or S at position 3, V at position 4, D at position 6, either I or F at position 9, L at position 10, S at position 13, S at position 14, K at position 15, C at position 16, T or R at position 17, either C or S or K at position 20, T at position 24, Q at position 26, F at position 28, T at position 29, A at position 30, L at position 31, G at position 33, R at position 34, L at position 35, N at position 36, H at position 37, D at position 40, L at position 44, P at position 45, either P or A at position 47, N at position 52, V at position 54, R at position 55, D at position 56, K at position 58, G or D at position 61, V at position 63, R at position 72, I at position 75, P at position 76, C at position 78, Y at position 82, either S or L at position 84, A at position 85, E at position 91, D at position 93, Q or G at position 95, N at position 96, K at position 107, A at position 112, either T, S or G at position 114, A at position 115, P at position 117, N at position 120, E at position 121, P at position 122, R at position 126, V at position 130, S at position 133, A or V at position 134, L, W or V at position 136, H at position 139, I or R at position 142, S at position 144, S at position 146, T at position 152, S at position 153, either S or A at position 154, V at position 168, T at position 169, F at position 177, V at position 178, I at position 180, G or I at position 181, K at position 184, Y at position 186, L at position 194, N at position 198, M at position 199, E at position 215, G at position 236, V at position 237, L at position 238, T at position 240, either I or A or V at position 245, Y at position 249, V or I at position 252, and V at position 254, when optimally aligned with SEQ ID NO: 2. The present invention also provides an HHDH polynucleotide, SEQ ID NO: 1, that is codon optimized for expression in *E. coli*. The polypeptide encoded by this codon optimized polynucleotide corresponds to HHDH polypeptide from *Agrobacterium* sp. (SEQ ID NO: 2).

In addition, the present invention provides specific polynucleotides corresponding to SEQ ID NO: 3, 5, 7, 9, 11, 13, 15, 17, 19, 21, 23, 25, 27, 29, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 4712, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 739, and 741.

Those having ordinary skill in the art will readily appreciate that due to the degeneracy of the genetic code, a multitude of nucleotide sequences encoding HHDH polypeptides of the present invention exist. Table I is a Codon Table that provides the synonymous codons for each amino acid. For example, the codons AGA, AGG, CGA, CGC, CGG, and CGU all encode the amino acid arginine. Thus, at every position in the nucleic acids of the invention where an arginine is specified by a codon, the codon can be altered to any of the corresponding codons described above without altering the encoded polypeptide. It is understood that U in an RNA sequence corresponds to T in a DNA sequence.

TABLE 1

| Codon Table | | | |
|---|---|---|---|
| Amino acids | | | Codon |
| Alanine | Ala | A | GCA GCC GCG GCU |
| Cysteine | Cys | C | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

Such "silent variations" are one species of "conservative" variation. One of ordinary skill in the art will recognize that each codon in a nucleic acid (except AUG, which is ordinarily the only codon for methionine) can be modified by standard techniques to encode a functionally identical polypeptide. Accordingly, each silent variation of a nucleic acid which encodes a polypeptide is implicit in any described sequence. The invention contemplates and provides each and every possible variation of nucleic acid sequence encoding a polypeptide of the invention that could be made by selecting combinations based on possible codon choices. These combinations are made in accordance with the standard triplet genetic code (set forth in Table 1), as applied to the polynucleotide sequences of the present invention.

A group of two or more different codons that, when translated in the same context, all encode the same amino acid, are referred to herein as "synonymous codons." HHDH polynucleotides of the present invention may be codon optimized for expression in a particular host organism by modifying the polynucleotides to conform with the optimum codon usage of the desired host organism. Those having ordinary skill in the art will recognize that tables and other references providing preference information for a wide range of organisms are readily available See e.g., Henaut and Danchin in "*Escherichia coli* and *Salmonella*," Neidhardt, et al. Eds., ASM Pres, Washington D.C. (1996), pp. 2047-2066.

An exemplary HHDH variant polynucleotide sequence of the present invention is provided as SEQ ID NO: 31, which expresses well in *E. coli*. This polynucleotide is a variant of SEQ ID NO: 1 that expresses the polypeptide corresponding to SEQ ID NO: 2 from *E. coli* at a level of about 4½ fold higher than the amount expressed from SEQ ID NO: 1 (i.e., HHDH-encoding polynucleotide encoding native HHDH from *Agrobacterium* sp.).

In some embodiments of the present invention, certain codons are preferred when the following residues are employed in the HHDH polypeptides of the present invention: ATT encoding Isoleucine at amino acid position 5; AAG encoding Lysine at amino acid position 36; ATT encoding Isoleucine at amino acid position 63; GAG encoding Glutamic acid at amino acid position 95; and CCC encoding Proline at amino acid position 188. The amino acid position referred to above is the corresponding amino acid position in SEQ ID NO: 2, when the invention HHDH polypeptides are aligned with SEQ ID NO: 2.

The terms "conservatively modified variations" and "conservative variations" are used interchangeably herein to refer to those nucleic acids that encode identical or essentially identical amino acid sequences, or in the situation where the nucleic acids are not coding sequences, the term refers to nucleic acids that are identical. One of ordinary skill in the art will recognize that individual substitutions, deletions or additions which alter, add or delete a single amino acid or a small percentage of amino acids in an encoded sequence are considered conservatively modified variations where the alterations result in one or more of the following: the deletion of an amino acid, addition of an amino acid, or substitution of an amino acid with a chemically similar amino acid. When more than one amino acid is affected, the percentage is typically less than 5% of amino acid residues over the length of the encoded sequence, and more typically less than 2%. References providing amino acids that are considered conservative substitutions for one another are well known in the art.

Examples of conservative substitutions are within the group of basic amino acids (arginine, lysine and histidine), acidic amino acids (glutamic acid and aspartic acid), polar amino acids (glutamine and asparagines), hydrophobic amino acids (leucine, isoleucine and valine), aromatic amino acids (phenylalanine, tryptophan and tyrosine), and small amino acids (glycine, alanine, serine, threonine, proline, cysteine and methionine). Amino acid substitutions which do not generally alter the specific activity are known in the art and are described, for example, by H. Neurath and R. L. Hill, 1979, in "The Proteins," Academic Press, New York. The most commonly occurring exchanges are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly as well as these in reverse.

Conservatively substituted variations of the HHDH polypeptides of the present invention include substitutions of a small percentage, typically less than 5%, more typically less than 2%, and often less than 1% of the amino acids of the polypeptide sequence, with a conservatively selected amino acid of the same conservative substitution group. The addition of sequences which do not alter the encoded activity of an HHDH polynucleotide, such as the addition of a non-functional or non-coding sequence, is considered a conservative variation of the HHDH polynucleotide.

Polynucleotides of the present invention can be prepared using methods that are well known in the art. Typically, oligonucleotides of up to about 120 bases are individually synthesized, then joined (e.g., by enzymatic or chemical ligation methods, or polymerase-mediated methods) to form essentially any desired continuous sequence. For example, polynucleotides of the present invention can be prepared by chemical synthesis using, e.g., the classical phosphoramidite method described by Beaucage, et al. (1981) *Tetrahedron Letters*, 22:1859-69, or the method described by Matthes, et al. (1984) *EMBO J.*, 3:801-05., e.g., as is typically practiced in automated synthetic methods. According to the phosphoramidite method, oligonucleotides are synthesized, e.g., in an automatic DNA synthesizer, purified, annealed, ligated and cloned in appropriate vectors.

In addition, essentially any nucleic acid can be custom ordered from any of a variety of commercial sources, such as The Midland Certified Reagent Company (Midland, Tex.), The Great American Gene Company (Ramona, Calif.), ExpressGen Inc. (Chicago, Ill.), Operon Technologies Inc. (Alameda, Calif.), and many others.

Polynucleotides may also be synthesized by well-known techniques as described in the technical literature. See, e.g., Carruthers, et al., *Cold Spring Harbor Symp. Quant. Biol.*, 47:411-418 (1982) and Adams, et al., *J. Am. Chem. Soc.*, 105:661 (1983). Double stranded DNA fragments may then be obtained either by synthesizing the complementary strand and annealing the strands together under appropriate conditions, or by adding the complementary strand using DNA polymerase with an appropriate primer sequence.

General texts which describe molecular biological techniques useful herein, including the use of vectors, promoters and many other relevant topics, include Berger and Kimmel, *Guide to Molecular Cloning Techniques, Methods in Enzymology* volume 152 Academic Press, Inc., San Diego, Calif. (Berger); Sambrook et al., *Molecular Cloning—A Laboratory Manual* (2nd Ed.), Vol. 1-3, Cold Spring Harbor Laboratory, Cold Spring Harbor, N.Y., 1989 ("Sambrook") and *Current Protocols in Molecular Biology*, F. M. Ausubel et al., eds., Current Protocols, a joint venture between Greene Publishing Associates, Inc. and John Wiley & Sons, Inc., (supplemented through 1999) ("Ausubel"). Examples of protocols sufficient to direct persons of skill through in vitro amplification methods, including the polymerase chain reaction (PCR) the ligase chain reaction (LCR), Qβ-replicase amplification and other RNA polymerase mediated techniques (e.g., NASBA), e.g., for the production of the homologous nucleic acids of the invention are found in Berger, Sambrook, and Ausubel, as well as Mullis et al., (1987) U.S. Pat. No. 4,683,202; *PCR Protocols A Guide to Methods and Applications* (Innis et al. eds) Academic Press Inc. San Diego, Calif. (1990) (Innis); Arnheim & Levinson (Oct. 1, 1990) *C&EN* 36-47; The Journal Of NIH Research (1991) 3, 81-94; (Kwoh et al. (1989) *Proc. Natl. Acad. Sci. USA* 86, 1173; Guatelli et al. (1990) *Proc. Natl. Acad. Sci. USA* 87, 1874; Lomell et al. (1989) *J. Clin. Chem* 35, 1826; Landegren et al., (1988) *Science* 241, 1077-1080; Van Brunt (1990) *Biotechnology* 8, 291-294; Wu and Wallace, (1989) *Gene* 4, 560; Barringer et al. (1990) *Gene* 89, 117, and Sooknanan and Malek (1995) *Biotechnology* 13: 563-564. Improved methods for cloning in vitro amplified nucleic acids are described in Wallace et al., U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of ordinary skill in the art will readily appreciate that essentially any RNA can be converted into a double stranded DNA suitable for restriction digestion, PCR expansion and sequencing using reverse transcriptase and a polymerase. See, e.g., Ausubel, Sambrook and Berger, all supra.

Vectors, Promoters, and Expression Systems

The present invention also includes recombinant constructs comprising one or more of the HHDH polynucleotide sequences as broadly described above. The term "construct" or "nucleic acid construct" refers herein to a nucleic acid, either single- or double-stranded, which is isolated from a naturally occurring gene or which has been modified to contain segments of nucleic acids in a manner that would not otherwise exist in nature. The term "nucleic acid construct" is synonymous with the term "expression cassette" when the nucleic acid construct contains the control sequences required for expression of an HHDH coding sequence of the present invention.

The present invention also provides an expression vector comprising an HHDH polynucleotide of the present invention operably linked to a promoter. Example 1 provides a description of how to make expression constructs for expression of halohydrin dehalogenase. The term "control sequences" refers herein to all the components that are necessary or advantageous for the expression of a polypeptide of the present invention. Each control sequence may be native or foreign to the nucleotide sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleotide sequence encoding a polypeptide.

The term "operably linked" refers herein to a configuration in which a control sequence is appropriately placed at a position relative to the coding sequence of the DNA sequence such that the control sequence directs the expression of a polypeptide.

When used herein, the term "coding sequence" is intended to cover a nucleotide sequence, which directly specifies the amino acid sequence of its protein product. The boundaries of the coding sequence are generally determined by an open reading frame, which usually begins with the ATG start codon. The coding sequence typically includes a DNA, cDNA, and/or recombinant nucleotide sequence.

As used herein, the term "expression" includes any step involved in the production of the polypeptide including, but not limited to, transcription, post-transcriptional modification, translation, post-translational modification, and secretion.

The term "expression vector" refers herein to a DNA molecule, linear or circular, that comprises a segment encoding a polypeptide of the invention, and which is operably linked to additional segments that provide for its transcription.

As used herein, the term "host cell" refers to any cell type which is susceptible to transformation with a nucleic acid construct.

Nucleic acid constructs of the present invention comprise a vector, such as, a plasmid, a cosmid, a phage, a virus, a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

Polynucleotides of the present invention can be incorporated into any one of a variety of expression vectors suitable for expressing a polypeptide. Suitable vectors include chromosomal, nonchromosomal and synthetic DNA sequences, e.g., derivatives of SV40; bacterial plasmids; phage DNA; baculovirus; yeast plasmids; vectors derived from combinations of plasmids and phage DNA, viral DNA such as vaccinia, adenovirus, fowl pox virus, pseudorabies, adenovirus, adeno-associated virus, retroviruses and many others. Any vector that transduces genetic material into a cell, and, if replication is desired, which is replicable and viable in the relevant host can be used.

When incorporated into an expression vector, a polynucleotide of the invention is operatively linked to an appropriate transcription control sequence (promoter) to direct mRNA synthesis, e.g., T5 promoter. Examples of such transcription control sequences particularly suited for use in transgenic plants include the cauliflower mosaic virus (CaMV) and figwort mosaic virus (FMV). Other promoters known to control expression of genes in prokaryotic or eukaryotic cells or their viruses and which can be used in some embodiments of the invention include SV40 promoter, $E.\ coli$ lac or trp promoter, phage lambda $P_L$ promoter, tac promoter, T7 promoter, and the like. An expression vector optionally contains a ribosome binding site for translation initiation, and a transcription terminator, such as PinII. The vector also optionally includes appropriate sequences for amplifying expression, e.g., an enhancer.

In addition, the expression vectors of the present invention optionally contain one or more selectable marker genes to provide a phenotypic trait for selection of transformed host cells. Suitable marker genes include those coding for resistance to the antibiotic spectinomycin or streptomycin (e.g., the aada gene), the streptomycin phosphotransferase (SPT) gene coding for streptomycin resistance, the neomycin phosphotransferase (NPTII) gene encoding kanamycin or geneticin resistance, the hygromycin phosphotransferase (HPT) gene coding for hygromycin resistance. Additional selectable marker genes include dihydrofolate reductase or neomycin resistance for eukaryotic cell culture, and tetracycline or ampicillin resistance in $E.\ coli$.

An exemplary expression vector for the expression of HHDH polypeptides of the present invention is depicted in FIG. 1. Vectors of the present invention can be employed to transform an appropriate host to permit the host to express an invention protein or polypeptide. Examples of appropriate expression hosts include bacterial cells, such as $E.\ coli$, $B.\ subtilis$, and *Streptomyces*. In bacterial systems, a number of expression vectors may be selected, such as, for example, multifunctional $E.\ coli$ cloning and expression vectors.

HHDH polynucleotides of the invention can also be fused, for example, in-frame to nucleic acids encoding a secretion/localization sequence, to target polypeptide expression to a desired cellular compartment, membrane, or organelle of a cell, or to direct polypeptide secretion to the periplasmic space or into the cell culture media. Such sequences are known to those of skill, and include secretion leader peptides, organelle targeting sequences (e.g., nuclear localization sequences, endoplasmic reticulum (ER) retention signals, mitochondrial transit sequences, chloroplast transit sequences), membrane localization/anchor sequences (e.g., stop transfer sequences, GPI anchor sequences), and the like.

Expression Hosts

The present invention also relates to engineered host cells that are transduced (transformed or transfected) with a vector or construct of the invention (e.g., an invention cloning vector or an invention expression vector), as well as the production of polypeptides of the invention by recombinant techniques. The vector may be, for example, a plasmid, a viral particle, a phage, etc. The host cell can be a eukaryotic cell, such as a plant cell. Alternatively, the host cell can be a prokaryotic cell, such as a plant cell. Introduction of the construct into the host cell can be effected by calcium phosphate transfection, DEAE-Dextran mediated transfection, electroporation, or other common techniques (Davis, L., Dibner, M. and Battey, I. (1986) *Basic Methods in Molecular Biology*). The engineered host cells can be cultured in conventional nutrient media modified as appropriate for activating promoters, selecting transformants, or amplifying the HHDH polynucleotide. Culture conditions, such as temperature, pH and the like, are those previously used with the host cell selected for expression, and will be apparent to those skilled in the art and in the references cited herein, including, e.g., Sambrook, Ausubel and Berger, as well as e.g., Freshney (1994) *Culture of Animal Cells a Manual of Basic Technique*, third edition, Wiley- Liss, New York and the references cited therein.

HHDH polypeptides of the invention can be produced in non-animal cells such as plants, yeast, fungi, bacteria, and the like. In addition to Sambrook, Berger and Ausubel, details regarding non-animal cell culture can be found in Payne et al. (1992) *Plant Cell and Tissue Culture in Liquid Systems* John Wiley & Sons, Inc. New York, N.Y.; Gamborg and Phillips (eds) (1995) *Plant Cell Tissue and Organ Culture*; Fundamental Methods Springer Lab Manual, Springer-Verlag (Berlin Heidelberg New York) and Atlas and Parks (eds) *The Handbook of Microbiological Media* (1993) CRC Press, Boca Raton, Fla. The host cell can be a eukaryotic cell, such as a plant cell. Alternatively, the host cell can be a prokaryotic cell, such as a bacterial cell. Introduction of the construct into the host cell can be effected by calcium phosphate transfection, DEAE-Dextran mediated transfection, electroporation, or other common techniques (Davis, L., Dibner, M., and Battey, I. (1986) *Basic Methods in Molecular Biology*).

Fusion Polypeptides for Purification

HHDH polypeptides of the present invention may also be expressed as part of a fusion polypeptide to facilitate purification of the encoded HHDH polypeptide. Polynucleotides encoding such fusion polypeptides comprise a nucleic acid sequence corresponding to an HHDH polynucleotide of the present invention that is fused-in frame to a purification facilitating domain. As used herein, the term "purification facilitating domain" refers to a domain that mediates purification of the polypeptide to which it is fused. Suitable purification domains include metal chelating peptides, histidine-tryptophan modules that allow purification on immobilized metals, a sequence which binds glutathione (e.g., GST), a hemagglutinin (HA) tag (corresponding to an epitope derived from the influenza hemagglutinin protein; Wilson et al. (1984) *Cell*, 37:767), maltose binding protein sequences, the FLAG epitope utilized in the FLAGS extension/affinity purification system (Immunex Corp, Seattle, Wash.), and the like. The inclusion of a protease-cleavable polypeptide linker sequence between the purification domain and the HHDH polypeptide is useful to facilitate purification. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography, as described in Porath et al. (1992) *Protein Expression and Purification* 3:263-281) while the enterokinase cleavage site provides a means for separating the HHDH polypeptide from the fusion protein. pGEX vectors (Promega; Madison, Wis.) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

Production and Recovery of HHDH Polypeptides

The present invention further provides a method of making an HHDH polypeptide, said method comprising: (a) cultivating a host cell transformed with an HHDH polynucleotide under conditions suitable for the production of the HHDH polypeptide; and (b) recovering the HHDH polypeptide. Typically, recovery is from the host cell culture medium, the host cell or both, using protein recovery techniques that are well known in the art, including those described below.

Following transduction of a suitable host strain and growth (cultivating) of the host strain to an appropriate cell density, the selected promoter is induced by appropriate means (e.g., temperature shift or chemical induction) and cells are cultured for an additional period. Cells are typically harvested by centrifugation, disrupted by physical or chemical means, and the resulting crude extract retained for further purification. Microbial cells employed in expression of proteins can be disrupted by any convenient method, including freeze-thaw cycling, sonication, mechanical disruption, or use of cell lysing agents, or other methods, which are well known to those skilled in the art.

As noted, many references are available for the culture and production of many cells, including cells of bacterial, plant, animal (especially mammalian) and archebacterial origin. See e.g., Sambrook, Ausubel, and Berger (all supra), as well as Freshney (1994) *Culture of Animal Cells, a Manual of Basic Technique*, third edition, Wiley- Liss, New York and the references cited therein; Doyle and Griffiths (1997) *Mammalian Cell Culture: Essential Techniques* John Wiley and Sons, NY; Humason (1979) *Animal Tissue Techniques*, fourth edition W. H. Freeman and Company; and Ricciardelli, et al., (1989) *In vitro Cell Dev. Biol.* 25:1016-1024. For plant cell culture and regeneration, Payne et al. (1992) *Plant Cell and Tissue Culture in Liquid Systems* John Wiley & Sons, Inc. New York, N.Y.; Gamborg and Phillips (eds) (1995) *Plant Cell, Tissue and Organ Culture;* Fundamental Methods Springer Lab Manual, Springer-Verlag (Berlin Heidelberg New York); Jones, ed. (1984) *Plant Gene Transfer and Expression Protocols*, Humana Press, Totowa, N.J. and *Plant Molecular Biology* (1993) R. R. D. Croy, Ed. Bios Scientific Publishers, Oxford, U.K. ISBN 0 12 198370 6. Cell culture media in general are set forth in Atlas and Parks (eds.) *The Handbook of Microbiological Media* (1993) CRC Press, Boca Raton, Fla. Additional information for cell culture is found in available commercial literature such as the *Life Science Research Cell Culture Catalogue* (1998) from Sigma-Aldrich, Inc (St Louis, Mo.) ("Sigma-LSRCCC") and, e.g., *The Plant Culture Catalogue* and supplement (1997) also from Sigma-Aldrich, Inc (St Louis, Mo.) ("Sigma-PCCS").

HHDH polypeptides of the present invention can be recovered and purified from recombinant cell cultures by any of a number of methods well known in the art, including ammonium sulfate or solvent (e.g., ethanol, acetone, and the like) precipitation, acid extraction, anion or cation exchange chromatography, phosphocellulose chromatography, hydrophobic interaction chromatography, affinity chromatography (e.g., using any of the tagging systems noted herein), hydroxylapatite chromatography, and lectin chromatography. Protein refolding steps can be used, as desired, in completing the configuration of the mature protein. Finally, high performance liquid chromatography (HPLC) can be employed in the final purification steps. In addition to the references noted supra, a variety of purification methods are well known in the art, including, e.g., those set forth in Sandana (1997) *Bioseparation of Proteins*, Academic Press, Inc.; and Bollag et al. (1996) *Protein Methods, $2^{nd}$ Edition*, Wiley- Liss, NY; Walker (1996) *The Protein Protocols Handbook* Humana Press, NJ, Harris and Angal (1990) *Protein Purification Applications: A Practical Approach*, IRL Press at Oxford, Oxford, England; Harris and Angal *Protein Purification Methods: A Practical Approach*, IRL Press at Oxford, Oxford, England; Scopes (1993) *Protein Purification: Principles and Practice 3rd Edition*, Springer Verlag, N.Y.; Janson and Ryden (1998) *Protein Purification: Principles, High Resolution Methods and Applications. Second Edition*, Wiley-VCH, NY; and Walker (1998) *Protein Protocols on CD-ROM*, Humana Press, NJ.

In some cases it may be desirable to produce the HHDH polypeptides of the invention on a large scale suitable for industrial and/or commercial applications. In such cases bulk fermentation procedures are employed. An exemplary bulk fermentation procedure for producing HHDH is provided in Example 2. Briefly, an HHDH polynucleotide, is cloned into an expression vector, such as, for example, the vector depicted in FIG. 1 (PCK110700). After inserting the polynucleotide of interest into a vector, the vector is tranformed into a bacterial host, such as, for example, *E. coli* BL21 (Strategene, La Jolla, Calif.) after passage through *E. coli* TOP10 (Invitrogen, Carlsbad, Calif.) using standard methods.

The transformed cells are cultivated in a nutrient medium suitable for production of the polypeptide using methods that are known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). The secreted polypeptide can be recovered directly from the nutrient (culture) medium.

The resulting polypeptide may be isolated by methods known in the art. For example, the polypeptide may be isolated from the nutrient medium by conventional procedures including, but not limited to, centrifugation, filtration, extraction, spray-drying, evaporation, or precipitation. The isolated polypeptide may then be further purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), or extraction (see, e.g., Bollag et al. (1996) *Protein Methods, 2nd Edition*, Wiley- Liss, NY; Walker (1996) *The Protein Protocols Handbook*, Humana Press, NJ; Bollag et al. (1996) *Protein Methods, 2nd Edition*, Wiley- Liss, NY; Walker (1996) *The Protein Protocols Handbook*, Humana Press, NJ). A procedure for recovering the HHDH polypeptide from a cell lysate is illustrated in Example 3.

It is believed that the pI of the wild-type HHDH of SEQ ID NO: 2 maybe too low for polyethyleneimine (PEI) precipitation to be used to purify HHDH from DNA. Applicants have discovered that they could make the following residue changes relative to the alignment in SEQ ID NO: 2 to produce HHDH polypeptides of the present invention that have a sufficiently high pI to allow for isolation by PEI precipitation, but without loss of HHDH enzyme activity: E40Q,K, E42Q, K, E46Q,K, E56Q,K, E58Q,K, E61Q,K, and E64Q,K. Thus, in another embodiment, the present invention is directed to an HHDH polypeptide that can be isolated from solution by PEI precipitation, the HHDH polypeptide, when aligned with SEQ ID NO: 2, having five or more of the residue changes selected from the group consisting of E40Q,K, E42Q,K, E46Q,K, E56Q,K, E58Q,K, E61Q,K, and E64Q,K. For example, PEI precipitation was applied to the HHDH polypeptide of SEQ ID NO: 744:

```
MSTAIVTNVKHFGGMGSALRLSEAGHTVACHDESFKHQDQLKAFAKTYPQ

LIPMSEQEPAELIEAVTSALGQVDVLVSNDIYPVEWRPIDKYAVEDYRGT

VEALQIKPFALVNAVASQMKKRKSGHIIFITSAAPFGPWKELSTYSSARA

GASALANALSKELGEYNIPVFAIAPNYLHSGDSPYYYPTEPWKTSPEHVA

HVRKVTALQRLGTQKELGELVAFLASGSCDYLTGQVFWLTGGFPVIERWP

GMPE.
```

This polypeptide is encoded by the polynucleotide of SEQ ID NO: 743:

```
atgagcaccgctattgtcaccaacgtcaaacattttggaggtatgggtag cgctctgcgtctgagcgaagctggtcataccgtcgcttgccatgatgaaa gctttaagcatcaggatcaactgaaagcttttgctaaaacctacccacag ctgatcccaatgagcgaacaggaaccagctgaactgattgaagctgtcac cagcgctcttggtcaggtcgatgtactggtcagcaacgatatctatcctg tggaatggcggccaatcgataaatacgctgtcgaggattacaggggtact gtcgaagctctgcagatcaagccatttgctctagtgaatgctgtcgcttc gcaaatgaagaagcgaaagtcggggcacatcatcttcatcacttcggctg ccccgttcgggccatggaaggagctatcgacttactcttcggctcgagct ggggctagtgcactagctaatgctctatcgaaggagctaggagagtacaa tatcccggtgttcgctatcgctccgaattacctacactcggggattcgc cgtactattacccactgagccgtggaagacttctccggagcacgtggct cacgtgcgtaaggtgactgctctacaacgactagggactcaaaaagagct gggggaattggtggcattttggcatctggctcttgtgattatttgactg gccaggtgttttggttgacaggcggctttcccgtcatcgaacgttggccc ggcatgcccgaataatgaggatccggccaaactgttgtccgtctgcatca cctctaggtaatgtgagcggatacgatgccc.
```

Cell-free transcription/translation systems can also be employed to produce HHDH polypeptides using the polynucleotides of the present invention. Several such systems are commercially available. A general guide to in vitro transcription and translation protocols is found in Tymms (1995) *In vitro Transcription and Translation Protocols: Methods in Molecular Biology*, Volume 37, Garland Publishing, NY.

Ethyl-4-chloroacetoacetate (ECAA) is the substrate for the coupled reduction reaction using KRED/GDH to produce ethyl (S)4-chloro-3-hydroxybutyrate (ECHB). The ECHB is then used as substrate for the HHDH reaction. However, the ECAA starting material is a potent inhibitor ($K_i$ approximately=70 μM) of HHDH. Because the KRED/GDH catalyzed reaction may go to 99.9% completion, instead of the desired 99.97%, then 0.1% ECAA remains in the ECHB material and this 0.1% ECAA can inhibit the HHDH reaction. In other words, the remaining substrate from the first reaction is an inhibitor in the second reaction. Hence, it is desirable that the HHDH polypeptides of the present invention have resistance to inhibition by ECAA.

Applicants have discovered that they could make the following residue changes relative to the alignment in SEQ ID NO: 2 to produce HHDH polypeptides of the present invention that demonstrate increased resistance against inhibition by ECAA: A4V, A82Y,A134V, G136W, G136V, L142R, L178V, W238L, A240T, W249Y, M252I. Thus, in another embodiment, the present invention is directed to an HHDH polypeptide is resistant to inhibition by ECAA, the HHDH polypeptide, when aligned with SEQ ID NO: 2, having one or more of the residue changes selected from the group consisting of A4V, F82Y, T134V, F136W, F136V, L142R, L178V, W238L, A240T, W249Y and M252I.

A method for testing the HHDH polypeptides of the present invention for their reactivity in the presence of ECAA is disclosed in Example 5C herein. A gas chromatographic method for screening the reaction products from Example 5C, and determining the amount of product produced, is disclosed in Example 6B herein.

Methods of Using HHDH Polypeptides

As described supra, HHDH polypeptides of the present invention can be used to catalyze the conversion of 4-halo-3-hydroxybutyric acid derivatives to 4-nucleophile substituted-3-hydroxybutyric acid derivatives. The novel halohydrin dehalogenases of the present invention are also useful in the process for enzymatically resolving a mixture of enantiomeric epoxides by reacting the mixture with an anionic nucleophile in the presence of the halohydrin dehalogenase, wherein the enzyme preferentially reacts one of the epoxide enantiomers with the nucleophile to form a mixture of the resulting enantiomerically enriched vicinal nucleophile-substituted alcohol and the unreacted epoxide enriched in the other enantiomer, in the manner disclosed in publication WO 01/90397, which is incorporated herein by reference in its entirety.

The foregoing and other aspects of the invention may be better understood in connection with the following non-limiting examples.

EXAMPLES

Example 1

Construction of Expression Constructs for Expression of Halohydrin Dehalogenase

The gene for *Agrobacterium* sp. halohydrin dehalogenase was codon optimized (SEQ ID NO: 1) for expression in *E. coli* based on the amino acid sequence of the halohydrin dehalogenase from *Agrobacterium* sp. (SEQ ID NO: 2). The gene was synthesized using 60-mer oligomers, and cloned into expression vector PCK110700 (depicted in FIG. 1) under the control of a T5 promoter. The vector was transformed into *E. coli* TOP10 (Invitrogen, Carlsbad, Calif.) from which plasmid DNA was prepared using standard methods. The plasmid DNA was then transformed into *E. coli* BL21 (Stratagene, La Jolla, Calif.), the expression host, using standard methods. A clone was found in the expression library that expressed active HHDH. The gene from this clone was sequenced (see SEQ ID NO: 1 (HHDH.1)) and found to encode *Agrobacterium* sp. HHDH (SEQ ID NO: 2).

Polynucleotides encoding halohydrin dehalogenases of the present invention were similarly cloned into vector PCK 110700, depicted in FIG. 1, then transformed and expressed from *E. coli* BL21 after passage through *E. coli* TOP10 using standard methods.

Example 2

Production of HHDH

In an aerated agitated fermentor, 10.0 L of growth medium containing 0.528 g/L ammonium sulphate; 7.5 g/L of di-potassium hydrogen phosphate trihydrate; 3.7 g/L of potassium dihydrogen phosphate; 2 g/L of Tastone-154 yeast extract; 0.05 g/L ferrous sulphate; and 3 ml/L of a trace element solution containing 2 g/L of calcium chloride dihydrate, 2.2 g/L of zinc sulfate septahydrate, 0.5 g/L manganese sulfate monohydrate, 1 g/L cuprous sulfate heptahydrate: 0.1 g/l sodium borate decahydrate and 0.5 g/L EDTA, was brought to a temperature of 30° C. The fermentor was inoculated with a late exponential culture of *Escherchia coli* BL21 (Stratagene, La Jolla, Calif.) equipped with plasmid containing HHDH polynucleotides as described in Example 1, then grown in a shake flask containing LB, 1% glucose (Sigma Chemical Co., St. Louis, Mo.), and 30 µg/ml chloroamphenicol (Sigma Chemical Co., St. Louis, Mo.) to a starting optical density at 600 nm ($OD_{600}$) of 0.5 to 2.0. The fermentor was agitated at 500-1500 rpm and air was supplied to the fermentation vessel at 1.0-15.0 L/min to maintain a dissolved oxygen level of 30% saturation or greater. The pH of the culture was controlled at 7.0 by addition of 20% v/v ammonium hydroxide. After the culture reached an $OD_{600}$ of 40, the temperature was maintained at 30° C. and the expression of halohydrin dehalogenase was induced by the addition of isopropyl-β-D-thiogalactoside (IPTG) (Sigma Chemical Corp., St. Louis, Mo.) to a final concentration of 1 mM. The culture was grown for another 15 hours. After the induction, the cells were harvested by centrifugation and washed with 10 mM potassium phosphate buffer, pH 7.0. The cell paste was used directly in the downstream recovery process or was stored at −80° C. until use.

Example 3

Enzyme Preparation

The cell paste from Example 2 was washed by suspending 1 volume wet weight of cell paste in 3 volumes of 100 mM Tris/sulfate (pH 7.2) followed by centrifugation at 5000 g for 40 minutes in a Sorval 12BP. The washed cell paste was suspended in 2 volumes of lOOmM Tris/sulfate (pH 7.2). The intracellular HHDH was released from the cells by passing the suspension through a homogenizer in two passes using a pressure of 14,000 psig for the first pass and 8,000 psig for the second pass. The cell lysate was allowed to cool to 4° C. between passes through the homogenizer. The lysate is warmed to room temperature then either 2.5M $MnSO_4$ (50-350 mM final concentration), or a 10% w/v solution of polyethyleneimine (PEI), pH 7.2, (0.6-1.0% w/v final concentration) was added to the lysate and stirred for 30 minutes. The homogenate was centrifuged at between 5,000 and 10,000 g in a standard laboratory centrifuge for 30 to 60 minutes. The supernatant was desalted, concentrated by ultrafiltration, dispensed in shallow containers, frozen at −20° C. and lyophilized to a powder that was stored at −80° C.

To assess the quality of the preparation after fermentation, cell lysate containing the expressed halohydrin dehalogenase enzyme was assayed according to the following protocol. Approximately 50 µl of clarified cell lysate in 100 mM Tris- $SO_4$, 100 mM NaCN, pH 8.0 was mixed with 10 mM ethyl-(S)-4-chloro-3-hydroxybutyrate (ECHB) (Sigma Aldrich, St. Louis, Mo.). The total reaction volume was 0.2 ml. The reaction was incubated at room temperature for 30 min to 1 hour. The reaction was extracted with 7 volumes of ethyl acetate and the organic layer removed to a 1.8 ml gas chromatography (GC) vial. The organic layer was analyzed by GC for presence of the ethyl-(R)-4-cyano-3-hydroxybutyrate product. The amount of product produced was determined by comparison to a standard curve prepared and analyzed under the same conditions.

Example 4

High Throughput Screen for Presence of HHDH Activity

A. No Cyanohydrin in Agarose

The following screen was used to ascertain the presence of HHDH activity. On day 1, freshly transformed colonies on a Q-tray (Genetix USA, Inc. Beaverton, Oreg.) containing 200 ml LB agar+1% glucose, 30 μg/ml chloramphenicol were picked using a Q-bot® robot colony picker (Genetix USA, Inc., Beaverton, Oreg.) into shallow 384 well Nunc plates containing media (70 μL/well 2×YT+1% glucose, 30 μg/ml cam) (Nalge Nunc International, Rochester, N.Y.) for overnight growth at 30° C., 250 revolutions per minute (rpm), 85% relative humidity (RH). A negative control (*E. coli* BL21 with empty vector) and a positive control (*E. coli* BL21 with vector containing HHDH Mz1/2G5, SEQ ID NO: 31) were included. These master well plate cultures were covered with AirPore microporous tape (Qiagen, Inc., Valencia, Calif.).

On day 2, the master plate cultures were gridded onto nylon membranes (Pall Biodyne B Nylon Membrane pre-cut for Omnitray, 115×76 mm, Nalge Nunc #250385) then placed onto a Q-tray (Genetix USA, Inc. Beaverton, Oreg.) containing 200 ml LB agar+1% glucose, 30 μg/ml chloramphenicol. The Q-trays were incubated at 30° C. for 8-12 hours until growth was detected. Each nylon membrane was transferred to a Q-tray containing inducing media: 200 ml LB agar+1 mM IPTG, 30 μg/ml chloramphenicol. The Q-trays were then incubated at 23° C. or room temperature overnight.

On day 3, the assay plate was prepared as follows: a solution of 150 ml of 10 mM Tris-$SO_4$, pH 7.0, and 1.0% low melt agarose was prepared and cooled to about 45° C. 5M NaCl was added to give a final concentration of 500 mM NaCl. Bromcresol purple (BCP) and ethyl (S)-4-chloro-3-hydroxybutyrate (ECHB) were added to final concentrations of 0.004% and 0.3%, respectively. The solution was poured into a 150 ml Q-tray and allowed to solidify.

The nylon membrane with the colonies was removed from the Q tray containing inducing media and inverted onto the assay plate. The membrane was imaged through the inverted Q-tray using the Alpha Imaging ChemStation (Alpha Innotech Corporation, San Leandro, Calif.), aperture setting of 4 with a 420 nm (+/−10 nm filter). An image was acquired during the first hour of the reaction. The intensity data for each imaged spot was then normalized to the value of the negative control spots. A normalized value greater than one indicated the presence of HHDH activity. Active clones from this screen were further characterized using the method described in Example 5A. Clones from this screen may also be further characterized using the medium throughput assay described in Example 5B.

B. Cyanohydrin in Azarose

This high throughput screen is used when it is desired to screen for HHDH polypeptides that exhibit HHDH activity in the presence of cyanohydrin product, e.g., ethyl (R)-4-cyano-3-hydroxybutyrate. The protocol for days one and two are the same as in part A. On day 3, the assay plate was prepared as follows: a 150 ml low melt agarose solution was made up as follows: 10 mM Tris, pH 7.0, 2.0% low melt agarose (melted in microwave), 0.004% bromcresol purple (1.2 ml/150 ml). The solution was cooled to 37° C. overnight. On day three, ECHB (0.45 ml ECHB/150 ml solution) and ethyl (R)-4-cyano-3-hydroxybutyrate (8.26 ml ethyl (R)-4-cyano-3-hydroxybutyrate/150 ml solution) were added to give a 0.3% ECHB and 400 mM ethyl (R)-4-cyano-3-hydroxybutyrate solution. The solution was mixed and poured into a 150 ml Q-tray, then allowed to solidify as described in part A.

The nylon membrane with the colonies was removed from the Q tray containing the inducing media and inverted onto the assay plate. The membrane was imaged as described in part A above.

Active clones from this screen were further characterized using the gas chromatography method described in Example 5B (Medium through-put assay).

Example 5

Characterization of Halohydrin Dehalogenase Activity.

A. Gas Chromatography Method for Detection of Product Ethyl-(R)4-cyano-3-hydroxybutyrate To a solution of ethyl (S)-4-chloro-3-hydroxybutyrate (10 mM-100 mM) in 500 mM HCN (500 mM NaCN adjusted to pH 7.0 with phosphoric acid) was added the halohydrin dehalogenase enzyme as a predissolved solution in the same buffer. Over time, aliquots of the mixture were withdrawn and extracted with three volumes of ethyl acetate. The organic layer was then analysed for ethyl (R)-4-cyano-3-hydroxybutyrate by gas chromatography (GC), as described hereinbelow in Example 6. Samples were taken at various time points, and the peak area of the product cyanohydrin, ethyl (R)-4-cyano-3-hydroxybutyrate, was plotted as a function of time. Time points are selected at low conversion, for example, less than 5% conversion, to avoid the effect of product inhibition (e.g., 0.5%, 1.0%, 1.5%, 2.0%, 2.5%, 3.0%, etc.). The peak areas were converted to concentration units using a standard curve that was prepared for the ethyl (R)-4-cyano-3-hydroxybutyrate. Activity of the halohydrin dehalogenase was determined in units of Hmol (cyanohydrin produced)/min/mg (total halohydrin dehalogenase catalyst). Relative activities of some of the clones are shown in Table 2, computed as Activity of Improved HHDH Enzyrme/Activity of *Agrobacterium* sp. HHDH (SEQ ID NO: 2).

TABLE 2

| Relative HHDH Activity of Improved HHDH Enzymes on ECHB Substrate | |
|---|---|
| SEQ ID NO: | Fold Improvement in HHDH Activity of *Agrobacterium* sp. HHDH (SEQ ID NO: 2) |
| (SEQ ID NO: 4) | 1.5 |
| (SEQ ID NO: 6) | 1.6 |
| (SEQ ID NO: 8) | 1.8 |
| (SEQ ID NO: 10) | 1.7 |
| (SEQ ID NO: 34) | 2.4 |
| (SEQ ID NO: 12) | 2.5 |

TABLE 2-continued

Relative HHDH Activity of Improved
HHDH Enzymes on ECHB Substrate

| SEQ ID NO: | Fold Improvement in HHDH Activity of Agrobacterium sp. HHDH (SEQ ID NO: 2) |
|---|---|
| (SEQ ID NO: 14) | 1.4 |
| (SEQ ID NO: 16) | 2.0 |
| (SEQ ID NO: 18) | 2.7 |
| (SEQ ID NO: 20) | 3.8 |
| (SEQ ID NO: 22) | 2.5 |
| (SEQ ID NO: 24) | 3.2 |
| (SEQ ID NO: 26) | 1.7 |
| (SEQ ID NO: 28) | 2.2 |
| (SEQ ID NO: 30) | 2.8 |

B. Medium Throughput-Gas Chromatography Assay in Presence of Cyanohydrin Product Hits were picked from desired wells (10 µL of culture) in the prescreen master well plates and transferred into the wells of 96 well NUNC plates (each well containing 200 ul LB +1% glucose, 30 µg/ml chloramphenicol (cam)) for overnight growth at 30° C., 250 rpm, 85% relative humidity. The positive controls were picked from the prescreen master well plates.

The next day, 10 µl aliquots of the overnight growth was subcultured into 96 deep well plates each well containing 300 µl 2×YT, 100 mM NaH$_2$PO$_4$/Na$_2$HPO$_4$ pH 7, 1 mM MgSO$_4$, 30 µg/ml cam. These plates were incubated at 30° C., 250 rpm, 85% relative humidity, 2-4 hrs, until the cell density reached an OD 600nm=0.6. The plates were then induced with 1 mM isopropyl-β-D-thiogalactoside (IPTG) (e.g., 10 µl/well of a 34 mM IPTG stock solution or 30 uL/well of 10 mM IPTG stock) and incubated at 30° C. overnight, 250 rpm, 85% relative humidity. The next day, the plates were centrifuged (4000 rpm, 10 min., 4° C.) to pellet the cells and the spent media was discarded. The plates can be frozen at −80° C. for one hour to aid in cell breakage.

The pelleted cells were lysed by adding 200 µL B-PER® lysing solution (Pierce, cat# 78243) containing 2.04 M ethyl-4-cyano-3-hydroxybutyrate ("NH") (320 g/L)(fw=157, d 1.19, 26.8 ml/100 ml lysis mixture) and 1 ul/10 ml DNase (~200 U/ul). The mixture of cells and lysing solution was vortexed to resuspend the cells and then incubated at 50° C. with shaking for two hours.

A reaction solution was made up in a fume hood, preferably using a plastic (polypropylene) disposal container. The volume of reaction solution was determined by number of plates screened. To prepare the reaction solution having a 1M final concentration of NaCN, NaCN (fw=49.01, 4.9 g/100 mL) was added to the desired volume of 100 mM sodium phosphate pH 7 to give 1.47M concentration of NaCN. To each 68 mL of the NaCN solution was added 24 mL of 5M stock NaCl and 8 ml of concentrated HCl (~10 M) to produce the desired volume of reaction mixture that was 1.2 M NaCl, 800 mM HCl, and 1 M NaCN. The final pH of the reaction mixture was 7.0-7.2. To this solution was added ECHB (fw=166.6, d=1.19) at 280 µL/100 mL reaction mix to obtain a 20 mM final concentration. The final concentrations in the reaction mix are ~1 M HCN, 2M NaCl, 50 mM sodium phosphate pH 7.0 to 7.2, 20 mM ECHB.

200 µL of the reaction mixture was added to the lysed cells in each well. The plates were sealed using the Velocity11 PlateLoc™ heat sealer. The sealed plates were then shaken at room temperature for 120 minutes. After shaking, the plates were unsealed and 1 mL of 1 mM thymol (dissolved in ethyl acetate) was added to each well. The plates were resealed using the Velocity11 PlateLoc™ heat sealer, shaken vigorously, then allowed to sit for ~1 minute to let the layers separate 150 µL aliquots of the upper layer were transferred to Costar round bottom shallow well polypropylene (PP) reaction plates (Cat# 3365) using a Hydra positive displacement liquid handler (Asp mode, AV 150, AH 2650, EH 37800, WH 3730, WV full, Wash 3). Samples were transferred from the deep well plate into the shallow well plates.

These plates were sealed using the Velocity11 PlateLoc™ heat sealer and stored at −20° C. until analysis by Gas Chromatography as described in Example 6B.

C. Medium Throughput-Gas Chromatography Assay for Inhibition in the Presence of Ethyl-4-Chloroacetoacetate (ECAA)

Hits were picked from desired wells (10 µL of culture) in the prescreen master well plates and transferred into the wells of 96 well NUNC plates (each well containing 200 ul LB +1% glucose, 30 µg/ml chloramphenicol (cam)) for overnight growth at 30° C., 250 rpm, 85% relative humidity. The positive controls were picked from the prescreen master well plates.

The next day, 10 µl aliquots of the overnight growth was subcultured into 96 deep well plates, each well containing 300 µl 2×YT, 100 mM NaH$_2$PO$_4$/Na$_2$HPO$_4$ pH 7, 1 mM MgSO$_4$, 30 µg/ml cam. These plates were incubated at 30° C., 250 rpm, 85% relative humidity, 2-4 hrs, until the cell density reached an OD 600nm =0.6. The plates were then induced with 1 mM IPTG (e.g., 10 µl/well of a 34 mM IPTG stock solution or 30 µL/well of 10 mM IPTG stock) and incubated at 30° C. overnight, 250 rpm, 85% relative humidity.

The next day, the plates were centrifuged (4000 rpm, 10 min., 4° C.) to pellet the cells and the spent media was discarded. The plates can be frozen at −80° C. for one hour to aid in cell breakage.

The pelleted cells were lysed by adding 200 µL B-PER® lysing solution (Pierce, cat# 78243) with 1 ul/10 ml DNase (~200 U/ul). The mixture of cells and lysing solution was vortexed to resuspend the cells and then incubated at 50° C. with shaking for two hours.

A reaction solution was made up in a fume hood, preferably using a plastic (PP) disposal container (volume determined by number of plates screened). To prepare the reaction solution having a 1M final concentration of NaCN, NaCN (fw=49.01, 4.9 g/100 mL) was added to the desired volume of 100 mM sodium phosphate pH 7 to give 1.47M concentration of NaCN. To each 68 mL of the NaCN solution was added 24 mL of 5M stock NaCl and 8 ml of concentrated HCl (~10M) to produce the desired volume of reaction mixture that was 1.2 M NaCl, 800 mM HCl, and 1 M NaCN. The final pH of the reaction mixture is 7.0-7.2. To this solution is added ECHB (fw=166.6, d=1.19) to 100 mM final concentration (1400 µL/100 mL reaction mix) and ECAA (fw=164.6, d=1.21) to 5 mM final concentration (100 µL/100 mL reaction mix).

200 µL of the reaction mixture was added to the lysed cells in each well. The plates were sealed using the Velocity11 PlateLoc™ heat sealer. The sealed plates were then shaken at room temperature for 60 minutes. After shaking, the plates were unsealed and 1 mL of 1 mM thymol (dissolved in ethyl acetate) was added to each well. The plates were resealed using the Velocity11 PlateLoc™ heat sealer, shaken vigorously, then allowed to sit for ~1 minute to let the layers separate 150 µl aliquots of the upper layer were transferred to Costar round bottom shallow well polypropylene (PP) reaction plates (Cat# 3365) using a Hydra™ positive displacement liquid handler (Asp mode, AV 150, AH 2650, EH 37800, WH 3730, WV full, Wash 3). Samples were transferred from the deep well plate into the shallow well plates. These plates were sealed using the Velocity11 PlateLoc™ heat sealer and stored at −20° C. until analysis by Gas Chromatography as described in Example 6B.

Example 6

A. Detection of Ethyl (R)-4-cyano-3-hydroxybutyrate by Gas Chromotography

The ethyl (R)-4-cyano-3-hydroxybutyrate produced in Example 5A was analyzed using gas chromatography with flame ionization (FID) detection using an Agilent® HP-5 column, 30 m long, 0.32 mm inner diameter, film 0.25 µm, using the following program: 1 minute at 100° C., 5° C./minute for 10 minutes; 25° C./minute for 2 minutes; then 2 minutes at 200° C. Inlet and outlet temperatures were both 300° C., and the flow rate was 2 ml/minute. Under these conditions, ethyl (R)-4-cyano-3-hydroxybutyrate elutes at 6.25 minutes and ethyl (S)-4-chloro-3-hydroxybutyrate elutes at 4.5 minutes. Chemical purity of the species was measured using the integrated peak areas from the gas chromoatography results.

Enantioselectivity of the halohydrin dehalogenase (HHDH) with respect to ethyl (R)4-cyano-3-hydroxybutyrate was measured by gas chromatography and FID detection using a Restek gammaDex SA™ column (30 m long, 0.32 µm inner diameter) using the following program: 25 minutes at 165° C. and flow rate at 2 ml/min. Inlet and outlet temperatures were both at 230° C. Under these conditions ethyl (R)-4-cyano-3-hydroxybutyrate elutes at 19.6 minutes and ethyl (S)-4-cyano-3-hydroxybutyrate elutes at 19.2 minutes.

B. Detection of Remaining Ethyl (S)-4-chloro-3-hydroxybutyrate by Gas Chromatography Halohydrin dehalogenases of the present invention that exhibited activity in the presence of cyanohydrin product in the prescreen method of Example 4B, were further characterized in the assay described in Example 5B. The remaining ethyl (S)-4-chloro-3-hydroxybutyrate in the reaction mixture from Example 5B was analyzed using gas chromatography with an Agilentg 19091J-413 HP-5™ 5% phenyl methyl siloxane column, 30.0 m long×320 µm inner diameter×0.25 µm nominal, and a flow rate of 2.6 ml/min. The following program was used: 1 minute at 100° C., 50° C./minute for 2 minutes, 2 minutes hold, with a 10 minute cycle time. The detector conditions were as follows: 300° C., 40 ml/min $H_2$, 450 ml/min air. Under these conditions, ethyl (S)-4-chloro-3-hydroxybutyrate elutes at 3.12 minutes, ethyl (R)-4-cyano-3-hydroxybutyrate elutes at 3.06 minutes, and thymol elutes at 3.21 minutes. Activity may be characterized by the quantity of ethyl (S)-4-chloro-3-hydroxybutyrate remaining normalized to the extraction efficiency, i.e., Area ECHB/Area Thymol. Thymol is used as an internal standard for extraction efficiency of the reaction components from water to ethyl acetate.

Example 7

Manufacture of Ethyl (R)-4-cyano-3-hydroxybutyrate from Ethyl (S)-4-chloro-3-hydroxybutyrate To a 3-necked jacketed 3L flask equipped with a mechanical stirrer and connected to an automatic titrater by a pH electrode and a feeding tube for addition of base, was charged $H_2O$ (1200 mL), NaCN (37.25 g) and $NaH_2PO_4$ (125 g) to bring the solution to pH 7. The water circulator was set to 40° C. After 10 minutes, halohydrin dehalogenase SEQ ID NO: 32 as cell lysate (250 mL) was added. The reaction mixture was allowed to stir for 5 minutes. Using an addition funnel, ethyl (S)-4-chloro-3-hydroxybutyrate (45 g) was slowly added over 1 hour. The pH was maintained at 7 by the automatic titrater by the addition of 10 M NaOH (27 mL) over 17 hours. Subsequently, gas chromatography of a reaction sample showed complete conversion to product. Celite (16 g) was added to the flask, which was then connected to a diaphragm pump, whose exhaust is bubbled into 5M NaOH (200 mL), to remove HCN. The mixture was heated to 60° C. under 100 mm Hg pressure. After 1 hour, a submerged air bubbler was added to the solution to aid the removal of the HCN. After 3 hours, an HCN detector indicated less than 5 ppm HCN in the off-gas. The mixture was allowed to cool to room temperature, then filtered through a celite pad. The filtrate was extracted with butyl acetate (3×800 mL) and the combined organic layers filtered through a pad of activated charcoal. The solvent was removed under vacuum by rotary evaporation to provide 28.5 g of ethyl (R)-4-cyano-3-hydroxybutyrate. The purity was 98% (w/w) by HPLC and the enantiomeric excess was >99% (by chiral GC, the S enantiomer was undetectable). As used herein, the term "enantiomeric excess" or "e.e." refers to the absolute difference between the mole or weight fractions of major ($F_{(+)}$) and minor ($F_{(-)}$) enantiomers (i.e., $|F_{(+)}-F_{(-)}|$), where $F_{(+)}+F_{(-)}=1$. Percent e.e. is $100\times|F_{(+)}-F_{(-)}|$. Enantiomeric composition can be readily characterized by using the gas chromatography method described in Example 6, above, and using methods that are known in the art.

Examples 8-12

Conversion of Ethyl (R)-4-chloro-3-hydroxybutyrate to Ethyl (S)-4-cyano-3-hydroxybutyrate For each of Examples 8-12, to a 170 mL vessel connected to an automatic titrater by a pH electrode and a feeding tube for addition of base was charged NaCN (1.5 g, 31 mmol) and water (50 mL). The vessel was sealed and the pH was adjusted to 7 by the addition of conc. $H_2SO_4$ (0.9 mL). The reaction mixture was heated to 40° C. and treated with a solution of halohydrin dehalogenase (0.4 g in 10 mL water). The halohydrin dehalogenases used for these Examples had the polypeptide sequences given for the following SEQ ID NOs.:
Example 8 SEQ ID No: 32
Example 9 SEQ ID No: 90
Example 10 SEQ ID No: 94
Example 11 SEQ ID No: 96
Example 12 SEQ ID No: 98

Then, ethyl (S)-4-chloro-3-hydroxybutyrate (5.00 g, 30.1 mmol) was added via syringe. The automatic titrater maintained the pH at 7 by the addition of 4M NaCN. The progress of the reactions was monitored by recording the cumulative volume of the NaCN solution added vs. time.

Figure 2:
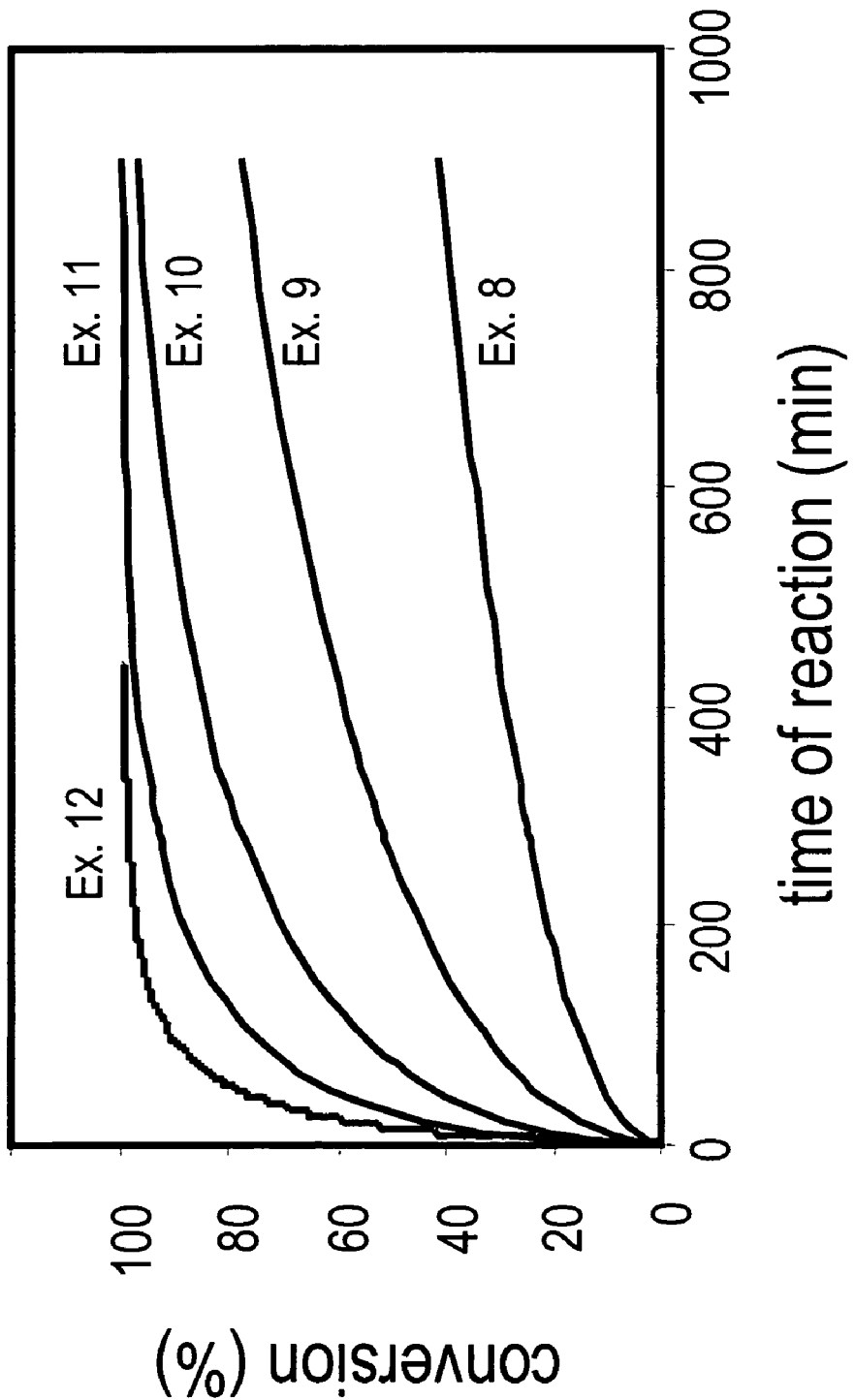
FIG. 2 depicts the percent conversion vs. time for the reactions of ethyl (S)-4-chloro-3-hydroxybutyrate with aqueous hydrocyanic acid in the presence of various halohydrin dehalogenase enzymes that are described in Examples 8 through 12.

FIG. 2 shows the percent conversion of ethyl (S)-4-chloro-3-hydroxybutyrate (calculated from the cumulative equivalents of NaCN added) vs. time for each of these Examples. Example 8 used a halohydrin dehalogenase having the amino acid sequence SEQ ID NO. 32, which is the amino acid sequence of the native halohydrin dehalogenase from *Agrobacterium radiobacter* AD1 (hheC), expressed from novel nucleic acid corresponding to SEQ ID NO. 31. Comparison of the percent conversion vs. time for Examples 9 through 12 to that of Example 8 shows that novel halohydrin dehalogenases of the present invention have greater activity than the native halohydrin dehalogenase from *Agrobacterium radiobacter* AD1 (hheC).

All publications, patents, patent applications, and other documents cited in this application are incorporated by reference in their entirety for all purposes to the same extent as if each individual publication, patent, patent application, or other document were individually indicated to be incorporated by reference for all purposes.

While preferred embodiments of the invention have been illustrated and described, it will be readily appreciated that various changes can be made therein without departing from the spirit and scope of the invention.

SEQUENCE LISTING (742 sequences)

SEQ ID NO: 1 - DNA, 765 bp, Artificial
  HHDH.1
  CDS (1)..(765)
atgagcaccgctatcgtcaccaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggggagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 2 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 3 - DNA, 765 bp, Artificial
  HHDH
  CDS (1)..(765)
atgagcaccgctatcgtcaccaacgtcaaacattttggtggtatgggtagcgctctaaggctgagcgaagctggtcataccgtcgcttgccatgatgaaagctttaaccagaaagatgaactggaagctttgcctgaaacctacccacagctgaaaccaatgagggaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtggaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcctatgatagaacgttggcccggcatgcccgaataa

SEQ ID NO: 4 - protein, 254 aa, Artificial
  Synthetic Construct
MSTAIVTNVKHFGGMGSALRLSEAGHTVACHDESFNQKDELEALPETYPQLKPMREQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 5 - DNA, 765 bp, Artificial
  HHDH
  CDS (1)..(765)
atgagcaccgctatcgtcaccaacgtcaaacattttggtggtatgggtagcgctctgaggctgagcgaaactggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 6 - protein, 254 aa, Artificial
  Synthetic Construct
MSTAIVTNVKHFGGMGSALRLSETGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 7 - DNA, 765 bp, Artificial
  HHDH
  CDS (1)..(765)
atgagcaccgctatcgtcaccaacgtcaaacattttggtggtatgggtagcgctctgagcctgagcgaagctggtcataccgtcacttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 8 - protein, 254 aa, Artificial
  Synthetic Construct
MSTAIVTNVKHFGGMGSALSLSEAGHTVTCHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 9 - DNA, 765 bp, Artificial
  HHDH
  CDS (1)..(765)
atgaccgccgctatcgtcaccaacgtcaaacattttggtggtatgggtagcgctctgaggctgagcgaagctggtcataccgtcacttgccatgatgaaaggttgaaacagaaagatgaactggaagcttttgctgaaacctacccacagctgaatccaatgagcgaacaggagccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagagcgttggcccggcatgcccgaataa

SEQ ID NO: 10 - protein, 254 aa, Artificial
  Synthetic Construct
MTAAIVTNVKHFGGMGSALRLSEAGHTVTCHDERLKQKDELEAFAETYPQLNPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 11 - DNA, 765 bp, Artificial
  HHDH
  CDS (1)..(765)
atgagccccgctatcgtcaccaacatcaaacattttagcggtatgtgtcgcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 12 - protein, 254 aa, Artificial
  Synthetic Construct
MSPAIVTNIKHFSGMCRALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 13 - DNA, 765 bp, Artificial
  HHDH
  CDS (1)..(765)
atgagcaccgctatcgacaccaacgtcaaacattttggtagtaagggtaccgctctgaggctgagcgaagctggtcataccgtcgcttgccatgatgaaagctttaaacagaaagatgatctggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacagaggtgctgtcgaagctctgcagatcaggccatttgctctagtgaatgctgtggcttcgcaaatgaagaagcgaaagtcggggcacatcatcttcatcacttcgagtactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccttggaagactaatccggagcacgtggctcacgtgaagaaggtgactgctctacaacggctagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 14 - protein, 254 aa, Artificial
  Synthetic Construct
MSTAIDTNVKHFGSKGTALRLSEAGHTVACHDESFKQKDDLEAFAETYPQLKPMSEQEPAELIEAVTSAYGQVDVLVSNDIFAPEFQPIDKYAVEDYRGAVEALQIRPFALVNAVASQMKKRKSGHIIFITSSTPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 15 - DNA, 765 bp, Artificial
  HHDH
  CDS (1)..(765)
atgagcaccgctatcgtcaccaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgctcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 16 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPLGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 17 - DNA, 765 bp, Artificial
  HHDH
  CDS (1)..(756)
atgagcaccgctatcgtcaccaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggggttttttttggcaggcggctttcccatgatagaacgttggcccggcatgcccgtataa

SEQ ID NO: 18 - protein, 252 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQGFFLAGGFPMIERWPGM

SEQ ID NO: 19 - DNA, 765 bp, Artificial
  HHDH
  CDS (1)..(765)
atgagccccgctatcgtcaccaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 20 - protein, 254 aa, Artificial
  Synthetic Construct
MSPAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 21 - DNA, 765 bp, Artificial
  HHDH
  CDS (1)..(765)
atgagcaccgctatcgtcaccaacgtcaaacattttggtggtatgggtagcgctctgaggctgagcgaagctggtcataccgtcgcttgccatgatgaaagctttaaccagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcgtgcccgaataa

SEQ ID NO: 22 - protein, 254 aa, Artificial
  Synthetic Construct
MSTAIVTNVKHFGGMGSALRLSEAGHTVACHDESFNQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGVPE

SEQ ID NO: 23 - DNA, 765 bp, Artificial
  HHDH
  CDS (1)..(765)
atgagcaccgctatcgtcaccaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacatggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 24 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHMAHVKKVTALQRLGTQKELGELVAFLASGSCDYLTGQVFWLAGGFPMIERWPGMPE

SEQ ID NO: 25 - DNA, 765 bp, Artificial; identical to SEQ ID NO: 15
  HHDH
  CDS (1)..(765)

SEQ ID NO: 26 - protein, 254 aa, Artificial; identical to SEQ ID NO: 16
  Synthetic Construct

SEQ ID NO: 27 - DNA, 765 bp, Artificial; identical to SEQ ID NO: 19
  HHDH
  CDS (1)..(756)

SEQ ID NO: 28 - protein, 252 aa, Artificial
  Synthetic Construct
MSPAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGM

SEQ ID NO: 29 - DNA, 765 bp, Artificial
  HHDH
  CDS (1)..(765)
atgagcaccgttatcgtcaccaacgtcaaacattttggtggtatgggtagcgctctgaggctgagcgaagccggtcataccgtcgcttgccatgatgaaagctttaaacagaaagatgaactggaagcttttgctgaaacttacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 30 - protein, 254 aa, Artificial
  Synthetic Construct
MSTVIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 31 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 32 - protein, 254 aa, Artificial; identical to SEQ ID NO: 2
  Synthetic Construct

SEQ ID NO: 33 - DNA, 765 bp, Artificial
  HHDH
  CDS (1)..(765)
atgagccccgctatcgtcactaacgtcaaacattttggtggtatgggtaccgctctgaggctgagcgaagctggtcaaaccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 34 - protein, 254 aa, Artificial
  Synthetic Construct
MSPAIVTNVKHFGGMGTALRLSEAGQTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 35 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgacctgattgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccataatagaacgttggcccggcatgcccgaataa

SEQ ID NO: 36 - protein, 254 aa, Artificial
  Synthetic Construct
MSTAIVTNVKHFGGMGSALRLSEAGHTVACHDESFKQKDELEAFAETYPQLKPMSEQEPADLIEAVTSAYGQVDVLVSNDIFAPEFQPIDKYAVENYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 37 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaagattacaggggtgctgtcgaagctctgcagatcaggccatttgctctagtgaatgctgtggctccgcaaatgaagaagcgaaagtcggggcacatcatcttcatcacttcggctactccgttcgggccatggaaggagctatcgacttacacttcggctcgagctggggcttgttctctagctaatgctctatcgaaggagctaggagagtacaatgtgccggtgttcgctatcgggccgaattacctacactcgggggattcgccgtacttctacccgactgagccgtggaagactaatccggagcacgtggctcacgtgaagaaggtgactgctctacaacgactagggactcaaaaagagttgggggaattggtggcattcttggcatctggctcttgtgattatttgactggccaggtgttttggttggcaggcggctttcccatgatagaacgttggcccggcatgcccgaataa

SEQ ID NO: 38 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIRPFALVNAVAPQMKKRKSGHIIFITSATPFGPWKELSTYTSARAGACSLANALSKELGEYNVPVFAIGPNYLHSGDSPYFYPTEPWKTNPEHVAHVKKVTALQRLGTQKELGELVAFLASGSCDYLTGQVFWLAGGFPMIERWPGMPE

SEQ ID NO: 39 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgattgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccataatagaacgttggcccggcatgcccgaataa

SEQ ID NO: 40 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 41 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgacctgattgaagctgtcaccagcgcttacggtcaggtcgatgtcctggtcagcaacgatatctttgctccagaatttcagccaatcgataaatacgctgtcgaagactacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccattatagaacgttggcccggcatgcccgaataa

SEQ ID NO: 42 - protein, 254 aa, Artificial
  Synthetic Construct
MSTAIVTNVKHFGGMGSALRLSEAGHTVACHDESFKQKDELEAFAETYPQLKPMSEQEPADLIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 43 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 44 - protein, 254 aa, Artificial
  Synthetic Construct
MSTAIVTNVKHFGGMGSALKLSEAGHTVACHDGSFKHKDELEAFAEAYPQLKPMSEQEPAELIEAVTSAFGHVDVLVSNDIFALEFRPIDKYAVEDYRGAVEALQIRPFALVNAVAPQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPAIERWPGMPE

SEQ ID NO: 45 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgctccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcttggcatctggctcttgtgattatttgactggccaggtgttttggttggcaggcggctttcccatgatagaacgttggcccggcatgcccgaataa

SEQ ID NO: 46 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSAAPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 47 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgagttacacttcggctcgagctggggcttgttctctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 48 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIRPFALVNAVASQMKKRKSGHIIFITSATPFGPWKELSSYTSARAGACSLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 49 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaggattacaggggtgctgtcgaagctctgcagatcaagccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 50 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIKPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 51 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaggattacaggggtgctgtcgaagctctgcagatcaggccatttgctctggcgaatgctgtggcttcgcaaatgaagaagcgaaagtcggggcacatcatcttcatcacttcggctgctccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 52 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIRPFALANAVASQMKKRKSGHIIFITSAAPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 53 - DNA, 765 bp, Artificial
  HHDH
  CDS (1)..(765)
atgaccaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgttctctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 54 - protein, 254 aa, Artificial
  Synthetic Construct
MTTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACSLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 55 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgattgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccataatagaacgttggcccggcatgcccgaataa

SEQ ID NO: 56 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVENYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 57 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 58 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 59 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgctgcgcatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 60 - protein, 254 aa, Artificial
  Synthetic Construct
MSTAIVTNVKHFGGMGSALRLSEAGHTVAAHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 61 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaagagctatcgacttacacttcggctcgagctggggcttgtgctctagctaatgctctatcgaaggagctaggagagtacaatatcccggtgttcgctatcgggccgaattacctacactcggaggattcgccgtacttctacccaactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccattatcgaacgttggcccggcatgcccgaataa

SEQ ID NO: 62 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACALANALSKELGEYNIPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 63 - DNA, 765 bp, Artificial; identical to SEQ ID NO: 61
  HHDH
  CDS (1)..(765)

SEQ ID NO: 64 - protein, 254 aa, Artificial; identical to SEQ ID NO: 62
  Synthetic Construct

SEQ ID NO: 65 - DNA, 765 bp, Artificial; identical to SEQ ID NO: 61
  HHDH
  CDS (1)..(765)

SEQ ID NO: 66 - protein, 254 aa, Artificial; identical to SEQ ID NO: 62
  Synthetic Construct

SEQ ID NO: 67 - DNA, 765 bp, Artificial
  HHDH
  CDS (1)..(765)
atgagcaccgctatcgtcaccaacgtcaaacattttggaggtatgggtagcgctctggggctgagcgaagctggtcataccgtcgcttgccatgatgaaagctttaaacacaaagatgaactggaagcttttgctgaaacctacccacagctgaaaccaatgagcgaacaggatccagctgacctgattgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctagctaatgctctatcgaaggagctaggagagtacaatgtgccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccattatcgaacgttggcccggcatgcccgaataa

SEQ ID NO: 68 - protein, 254 aa, Artificial
  Synthetic Construct
MSTAIVTNVKHFGGMGSALGLSEAGHTVACHDESFKHKDELEAFAETYPQLKPMSEQDPADLIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNVPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 69 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctgctccgttcgggccatggaaggagctatcgacttacacttcggctcgagctggggcttgttccctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 70 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIRPFALVNAVASQMKKRKSGHIIFITSAAPFGPWKELSTYTSARAGACSLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 71 - DNA, 765 bp, Artificial
  HHDH
  CDS (1)..(765)
atgagcaccgctatcgtcaccaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 72 - protein, 254 aa, Artificial; identical to SEQ ID NO: 2
  Synthetic Construct

SEQ ID NO: 73 - DNA, 765 bp, Artificial
  HHDH
  CDS (1)..(765)
atgagcaccgctatcgtcaccaacgtcaaacattttggaggtatgggtagtgctctgaggctgtcggaggctggtcacaccgtcgcttgccatgatgaaagctttaaacagaaagatgaactggaggcttttgctgaaacctacccacagctgaaaccaatgagcgaacaggaaccagctggactgattgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 74 - protein, 254 aa, Artificial
  Synthetic Construct
MSTAIVTNVKHFGGMGSALRLSEAGHTVACHDESFKQKDELEAFAETYPQLKPMSEQEPAGLIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 75 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattatcgtggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggaacacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 76 - protein, 254 aa, Artificial; identical to SEQ ID NO: 2
  Synthetic Construct

SEQ ID NO: 77 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccattatcgaacgttggcccggcatgcccgaataa

SEQ ID NO: 78 - protein, 254 aa, Artificial; identical to SEQ ID NO: 40
  Synthetic Construct

SEQ ID NO: 79 - DNA, 765 bp, Artificial
  HHDH
  CDS (1)..(765)
atgaccaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatatcctggtcagcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctgctccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 80 - protein, 254 aa, Artificial
  Synthetic Construct
MTTAIVTNVKHFGGMGSALRLSEAGHTVACHDESFKQKDELEAFAETYPQLKPMSEQEPAELIEAVTSAYGQVDILVSNDIFAPEFQPIDKYAVQDYRGAVEALQIRPFALVNAVASQMKKRKSGHIIFITSAAPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 81 - DNA, 765 bp, Artificial
  HHDH
  CDS (1)..(765)
atgaccaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctgctccgttcgggccatggaaggagctatcgacttacacttcggctcgagctggggcttgttccctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 82 - protein, 254 aa, Artificial
  Synthetic Construct
MTTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIRPFALVNAVASQMKKRKSGHIIFITSAAPFGPWKELSTYTSARAGACSLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 83 - DNA, 765 bp, Artificial; identical to SEQ ID NO: 79
  HHDH
  CDS (1)..(765)

SEQ ID NO: 84 - protein, 254 aa, Artificial; identical to SEQ ID NO: 80
  Synthetic Construct

SEQ ID NO: 85 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgcttcagaatttcagccaatcgataaatacgccgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattatctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 86 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFASEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 87 - DNA, 765 bp, Artificial
  HHDH
  CDS (1)..(765)
atgagcaccgctatcgtcaccaacgtcaagcattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtactattatccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 88 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYYYPTEPWKTNPEHVAHVKKVTALQRLGTQKELGELVAFLASGSCDYLTGQVFWLAGGFPMIERWPGMPE

SEQ ID NO: 89 - DNA, 765 bp, Artificial
  HHDH
  CDS (1)..(765)
atgagcaccgctatcgtcaccaacgtcaaacattttggaggtatgggtagcgctctgaggctgagcgaaggtggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 90 - protein, 254 aa, Artificial
  Synthetic Construct
MSTAIVTNVKHFGGMGSALRLSEGGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 91 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtactattacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 92 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAAPFGPWKELSTYTSARAGASTLANALSKELGEYNIPVFAIGPNYLHSEDSPYYYPTEPWKTNPEHVAHVKKVTALQRLGTQKELGELVAFLASGSCDYLTGQVFWLAGGFPMIERWPGMPE

SEQ ID NO: 93 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataa

SEQ ID NO: 94 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFQPIDKYAVEDYRGAVEALQIRPFALVNAVASQMKKRKSGHIIFITSAAPFGPWKELSTYTSARAGASTLANALSKELGEYNIPVFAIGPNYLHSEDSPYYYPTEPWKINPEHVAHVKKVTALQRLGTQKELGELVAFLASGSCDYLTGQVFWLAGGFPTIERWPGMPE

SEQ ID NO: 95 - DNA, 765 bp, Artificial
  HHDH
  CDS (1)..(765)
atgagcaccgctattgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataa

SEQ ID NO: 96 - protein, 254 aa, Artificial; identical to SEQ ID NO: 94
  Synthetic Construct

SEQ ID NO: 97 - DNA, 765 bp, Artificial
  HHDH
  CDS (1)..(765)
atgagcaccgctatcgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataa

SEQ ID NO: 98 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 99 - DNA, 765 bp, Artificial
  HHDH
  CDS (1)..(765)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataa

SEQ ID NO: 100 - protein, 254 aa, Artificial; identical to SEQ ID NO: 98
  Synthetic Construct

SEQ ID NO: 101 - DNA, 768 bp, Artificial
  HHDH
  CDS (1)..(768)
atgagcaccgctatcgtcaccaacgtcaaacattttggtggtatgggtagcgctctgaggctgagcgaagctggtcataccgtctcttgccatgatgaaagctttaaacagaaagatgaactggaagcttttgctgaaacctacccacagctgagaccaatgagcgaacaggaaccagctgaactgatcgaagctgtcaccagcgcttacggtcaggtcgatgtcctggtcagcaacgatatctttgctccagaatttcggccaatcgataaatacgctgtccaaaattacaggcgagctgtcgaagctctgcagatcatgccatttgctgtagagaatgctgtgacttcgcaaatgaagaagcgaaagtcggggcacatcatcttcatcacttccgctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 102 - protein, 254 aa, Artificial
  Synthetic Construct
MSTAIVTNVKHFGGMGSALRLSEAGHTVSCHDESFKQKDELEAFAETYPQLRPMSEQEPAELIEAVTSAYGQVDVLVSNDIFAPEFRPIDKYAVQNYRRAVEALQIMPFAVENAVTSQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 103 - DNA, 768 bp, Artificial
  HHDH
  CDS (1)..(768)
atgatcaccgcggccaacactaacttcaaactgaggggtggtatgggtagcgttccgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgtaagacgggtcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 104 - protein, 254 aa, Artificial
  Synthetic Construct
MITAANTNFKLRGGMGSVPRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKTGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 105 - DNA, 768 bp, Artificial
  HHDH
  CDS (1)..(768)
atgagcacagacatcgtcaccaacgtcaaacattttggaggtacgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcggcaacgatatctttgctccagaatttcagccaatcgataaatacgctgtcgaagattaccgtggtactgatgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggatagcccgtacttctacccgactgagccgtggaagactaatccggagcacgtggctcacgtgaagaaggtgactgctctacaacgactagggactcaaaaagagttgggggaattggtggcatttttggcatctggctctcgtgattatctgactgtgcaggtggtgtggctgccgggcggctttccgatgatagaacgttggcccggcatgcccgaataatga

SEQ ID NO: 106 - protein, 254 aa, Artificial
  Synthetic Construct
MSTDIVTNVKHFGGTGSALRLSEAGHTVACHDESFKQKDELEAFAETYPQLKPMSEQEPAELIEAVTSAYGQVDVLVGNDIFAPEFQPIDKYAVEDYRGTDEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSRDYLTVQVVWLPGGFPMIERWPGMPE

SEQ ID NO: 107 - DNA, 768 bp, Artificial
  HHDH
  CDS (1)..(768)
atgagcacggacggcgacaccacggtcaaacattttggaggtaaaggtagcgctctgaggctgagcgaagctggtcataccgtcgcttgccatgatgaaagctttaaacacaaagatgatctggaagcttttgctgaaccgtacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccagaactaccgtggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcagaaagagttgggggaattggtggcatttttggcatctggctcttgtgattatctgactgtgcaggtggtgtggctgaccggcgggtttccgatgatagaacgttggcccggcatgcccgaataatga

SEQ ID NO: 108 - protein, 254 aa, Artificial
  Synthetic Construct
MSTDGDTTVKHFGGKGSALRLSEAGHTVACHDESFKHKDDLEAFAEPYPQLKPMSEQEPAELIEAVTSAYGQVDVLVSNDIFAPEFQPIDKYAVQNYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTVQVVWLTGGFPMIERWPGMPE

SEQ ID NO: 109 - DNA, 768 bp, Artificial
  HHDH
  CDS (1)..(768)
atgagcaccgcaatcgtcaccacggtcaaacattttggaggtatgggtaaccctgtgaggcttagggaagctggtcatagcgtcacttgccatgataaaagctttaaacagaaagctgaactggaagcttttgctgaaacctgcccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggatagcccgtgtttctacccgactgagccgtggaagactaatccggagcacgtggctcacgtgaagaaggtgactgctctacaacgactagggactcaaaaagagttgggggaattggtggcatttttggcatctggctcttgtgattatctgactgtgcaggtggtgtggctgaccggcggctttcccatgatagaacgttggccgggcatgcccgaataatga

SEQ ID NO: 110 - protein, 254 aa, Artificial
  Synthetic Construct
MSTAIVTTVKHFGGMGNPVRLREAGHSVTCHDKSFKQKAELEAFAETCPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPCFYPTEPWKTNPEHVAHVKKVTALQRLGTQKELGELVAFLASGSCDYLTVQVVWLTGGFPMIERWPGMPE

SEQ ID NO: 111 - DNA, 768 bp, Artificial
  HHDH
  CDS (1)..(768)
atgagcaccgacatcgtcaccaacgtcaaacattttggaggtaaaggtagcgctctgaggctgagcgaagctggtctgagcgtcgcttgccatgatgaaagctttaaacagaaagatgaactggaagcttttgctgaaccgtacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattaccgtggtgctgtcgaagctctgcagatcaggccatttgctctagtgaatgctgtggcttcgcaaatgaagaagcgaaagtcggggcacatcatcttcatcacttcggctactccgttcgggccatggaaggaactatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctttacaacgactagggactcaaaaagagttgggggaattggtggcatttttggcatctggctcttgtgattatttgactggccaggtggtgtggctggcaggcggctttcccatgatagaacgtcggcccggcatgcccgaataatga

SEQ ID NO: 112 - protein, 254 aa, Artificial
  Synthetic Construct
MSTDIVTNVKHFGGKGSALRLSEAGLSVACHDESFKQKDELEAFAEPYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVVWLAGGFPMIERRPGMPE

SEQ ID NO: 113 - DNA, 768 bp, Artificial
  HHDH
  CDS (1)..(768)
atgagcaccgctatcgtcaccaacgtcaaacattttggaggtatgggtagcgctctgaggctgagcgaagctggtctgagcgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgatgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccgatgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtggtgtggttggcaggcggctttcccatgatagaacgttggcccggcatgcccgaataatga

SEQ ID NO: 114 - protein, 254 aa, Artificial
  Synthetic Construct
MSTAIVTNVKHFGGMGSALRLSEAGLSVACHDESFKQKDELEAFAETYPQLKPMSEQEPAELIEAVTSAYGQVDVLVSNDIFAPEFQPIDKYAVEDYRGADEALQIRPFALVNAVASQMKKRKSGHIIFITSATPFGPWKELSTYTSARAGACTLANALSKELGEYNIPMFAIGPNYLHSEDSPYFYPTEPWKTNPEHVAHVKKVTALQRLGTQKELGELVAFLASGSCDYLTGQVVWLAGGFPMIERWPGMPE

SEQ ID NO: 115 - DNA, 768 bp, Artificial
  HHDH
  CDS (1)..(768)
atgagcaccgtcatcgtcaccacggtcaaacattttggaggtatgggtagcgctctgaggctgagcgaagctggtcataccgtcgcttgccatgatgaaagctttaaacagaaagatgaactggaagcttttgctgaaccgtacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaaaactacaggggtgctgatgaagctctgcagatcaggccatttgctctagtgaatgctgtggcttcgcaaatgaagaagcgaaagtcggggcgtatcatcttcatcacttcggctactccgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctactcgactgagccgtggaagactaatccggagcacgtggctcacgtgaagaaggtgactgctctacaacgactagggactcaaaaagagttgggggaattggtggcatttttggcatctggctcttgtgattatttgactgtgcaggtggtgtggttggcaggcggctttcccatgatagaacgttggcccggcatgcccgaataatga

SEQ ID NO: 116 - protein, 254 aa, Artificial
  Synthetic Construct
MSTVIVTTVKHFGGMGSALRLSEAGHTVACHDESFKQKDELEAFAEPYPQLKPMSEQEPAELIEAVTSAYGQVDVLVSNDIFAPEFQPIDKYAVENYRGADEALQIRPFALVNAVASQMKKRKSGRIIFITSATPLGPWKELSTYTSARAGACTLANALSKELGEYNIPVFAIGPNYLHSEDSPYFYSTEPWKTNPEHVAHVKKVTALQRLGTQKELGELVAFLASGSCDYLTVQVVWLAGGFPMIERWPGMPE

SEQ ID NO: 117 - DNA, 768 bp, Artificial
  HHDH
  CDS (1)..(768)
atgagcaccgctatcgtcaccaacgtcaaacattttggaggtatgggtaccgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcaataaatacgctgtccaaaattacaggggtgctgtcgaagctctgcagatcaggccatttgctatagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgtgttggttggcaggcggctttcccatgatagaacgttggcccggcatgcccgaataatga

SEQ ID NO: 118 - protein, 254 aa, Artificial
  Synthetic Construct
MSTAIVTNVKHFGGMGTALRLSEAGHTVACHDESFKQKDELEAFAETYPQLKPMSEQEPAELIEAVTSAYGQVDVLVSNDIFAPEFQPINKYAVQNYRGAVEALQIRPFAIVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVCWLAGGFPMIERWPGMPE

SEQ ID NO: 119 - DNA, 768 bp, Artificial
  HHDH
  CDS (1)..(768)
atgagcaccgctatcgtcaccaacgtcaaacattttggaggtatgggtagcgctctgaggctgagcgaagctggtctgaccgtcgcttgccatgatgaaagctttaaacagaaagatgatctggaagcttttgctgaaacctacccacagctgaaaccaatgagcgaacaggatccagctgacctgattgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaagcgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccattatcgaacgttggcccggcatgcccgaataatga

SEQ ID NO: 120 - protein, 254 aa, Artificial
  Synthetic Construct
MSTAIVTNVKHFGGMGSALRLSEAGLTVACHDESFKQKDDLEAFAETYPQLKPMSEQDPADLIEAVTSAYGQVDVLVSNDIFAPEFQPIDKYAVENYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 121 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgatctggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaaacgaaagtcggggcacatcatcttcatcacttcgtctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccctaatagaacgttggcccggcatgcccgaataatga

SEQ ID NO: 122 - protein, 254 aa, Artificial
  Synthetic Construct
MSTAIVTNVKHFGGMGSALRLSEAGHTVACHDESFKQKDDLEAFAETYPQLKPMSEQEPAELIEAVTSAYGQVDVLVSNDIFAPEFQPIDKYAVENYRGAVEALQIRPFALVNAVASQMKKRKSGHIIFITSSTPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPLIERWPGMPE

SEQ ID NO: 123 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgatctggaagcttttgctgaaacctacccacagctgaaaccaatgagcgaacaggaaccagctgacctgattgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaagcgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccattatcgaacgttggcccggcatgcccgaataatga

SEQ ID NO: 124 - protein, 254 aa, Artificial
  Synthetic Construct
MSTAIVTNVKHFGGMGSALRLSEAGHTVACHDESFKQKDDLEAFAETYPQLKPMSEQEPADLIEAVTSAYGQVDVLVSNDIFAPEFQPIDKYAVENYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 125 - DNA, 768 bp, Artificial; identical to SEQ ID NO: 123
  HHDH
  CDS (1)..(768)

SEQ ID NO: 126 - protein, 254 aa, Artificial; identical to SEQ ID NO: 124
  Synthetic Construct

SEQ ID NO: 127 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccacaatttcagccagtcgaaaaatacgcagtcgaagattacaggggtgctgtcgaagctctgcagatcaggccatttgctctagtgaatgctgtggcttcgcaaatgaagaaacgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 128 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPQFQPVEKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 129 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccacaatttcagccagtggacaaatactcagtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 130 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPQFQPVDKYSVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 131 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccacaatttcagccagtcgacaaatacgcagtcgaagattacaggggtgctgtcgaagctctgcagatcaggccatttgctctagtgaatgctgtggcttcgcaaatgaagaagcgaaagtcggggcacatcatcttcatcacttcggctactccgttagggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtgatagaacgttggcctggcatgcccgaataatga

SEQ ID NO: 132 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPQFQPVDKYAVEDYRGAVEALQIRPFALVNAVASQMKKRKSGHIIFITSATPLGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPVIERWPGMPE

SEQ ID NO: 133 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggatccagctgacctgatcgaagctgtcaccagcgcttttggtcaggtcgatgtcctggtcagcaacgatatctttgctccagaatttcagccaatcgataaatacgctgtccaagattacaggggtgctgtcgaagctctgcagatcaggccatttgctctagtgaatgctgtggcttcgcaaatgaagaagcgaaagtcggggcacatcatcttcatcacttcggctgctccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 134 - protein, 254 aa, Artificial
  Synthetic Construct
MSTAIVTNVKHFGGMGSALRLSEAGHTVACHDESFKQKDELEAFAETYPQLKPMSEQDPADLIEAVTSAFGQVDVLVSNDIFAPEFQPIDKYAVQDYRGAVEALQIRPFALVNAVASQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 135 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtccaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 136 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFAPEFQPIDKYAVQDYRGAVEALQIRPFALVNAVASQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 137 - DNA, 768 bp, Artificial
  HHDH
  CDS (1)..(768)
atgagcgccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggcttgttccctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 138 - protein, 254 aa, Artificial
  Synthetic Construct
MSAAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIRPFALVNAVASQMKKRKSGHIIFITSAAPFGPWKELSTYTSARAGACSLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 139 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtccaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatacccgaataatga

SEQ ID NO: 140 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFAPEFQPIDKYAVQDYRGAVEALQIRPFALVNAVASQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGIPE

SEQ ID NO: 141 - DNA, 768 bp, Artificial
  HHDH
  CDS (1)..(768)
atgagcaccgctatcgtcaccaacttcacacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacatcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 142 - protein, 254 aa, Artificial
  Synthetic Construct
MSTAIVTNFTHFGGMGSALRLSEAGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 143 - DNA, 768 bp, Artificial
  HHDH
  CDS (1)..(768)
atgagcaccgctatcgtcaccaacttcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcatcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctaccccgttcgggccatggaaggagctatcgacttacacttcggctcgagctggggcttgtcccctagctaatgctctatcgaaggagctaggagagtacaatatcccggtgttcgctatcgggcctaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactgaccaggtgttttggttggcaggcggctttcccatgatagaacgttggcccggcatgcccgaataatga

SEQ ID NO: 144 - protein, 254 aa, Artificial
  Synthetic Construct
MSTAIVTNFKHFGGMGSALRLSEAGHTVACHDESFKQKDELEAFAETYPQLKPMSEQEPAELIEAVTSAYGQVDVLVINDIFAPEFQPIDKYAVQDYRGAVEALQIRPFALVNAVASQMKKRKSGHIIFITSATPFGPWKELSTYTSARAGACPLANALSKELGEYNIPVFAIGPNYLHSEDSPYFYPTEPWKTNPEHVAHVKKVTALQRLGTQKELGELVAFLASGSCDYLTDQVFWLAGGFPMIERWPGMPE

SEQ ID NO: 145 - DNA, 768 bp, Artificial
  HHDH
  CDS (1)..(768)
atgagcacggctatcgtgaccaacttcaaacattttggaggcatggacagcgctctgaggctgagcgaagctggtcataccgtcgcttgccatgatgaaagctttaaacagaaagatgaactggaagcttttgctgaaacctacccacagctgaaaccaatgagcgaacaagaaccatctgaactgatcgaagctgtcaccagcgcttttggtcaggtcgatgtcctggtcagcaacgatatctttgctccagaatttcagccaatcgataaatactctgtcgaagattacaggggtgctgtcgaagctctgcagatcaggccatttgccctagtgaatgctgcgactccccaaatgaagaagcgaaagtcggggcacattatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgaaccgtggaagactaatccggagcacgtggctcacgtgaagaaggtgactgctctacaacgactagggactcaaaaagagttgggggaattggtggcatttttggcatctggctcttgtgattatttggctggccaggtgttttggttggcaggcggctttcccgtgatagaacgttggcccggcatgcccgaataatga

SEQ ID NO: 146 - protein, 254 aa, Artificial
  Synthetic Construct
MSTAIVTNFKHFGGMDSALRLSEAGHTVACHDESFKQKDELEAFAETYPQLKPMSEQEPSELIEAVTSAFGQVDVLVSNDIFAPEFQPIDKYSVEDYRGAVEALQIRPFALVNAATPQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLAGQVFWLAGGFPVIERWPGMPE

SEQ ID NO: 147 - DNA, 768 bp, Artificial
  HHDH
  CDS (1)..(768)
atgagcaccgctatcgtcaccactttcaaacattttggaggtatgggtagcgttctcaggctgagcgaaggtggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 148 - protein, 254 aa, Artificial
  Synthetic Construct
MSTAIVTTFKHFGGMGSVLRLSEGGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 149 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcagccaatcgataaatacgctgtcgaagattacaggggtgctgtcgaagctctgcagatcaggccatttgctctagtgaatgctgtggctccgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataatga

SEQ ID NO: 150 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFQPIDKYAVEDYRGAVEALQIRPFALVNAVAPQMKKRKSGHIIFITSAAPFGPWKELSTYTSARAGASTLANALSKELGEYNIPVFAIGPNYLHSEDSPYYYPTEPWKINPEHVAHVKKVTALQRLGTQKELGELVAFLASGSCDYLTGQVFWLAGGFPTIERWPGMPE

SEQ ID NO: 151 - DNA, 768 bp, Artificial
  HHDH
  CDS (1)..(768)
atgagcaccgctattgtcaccaacgtcaaacattttggaggtatgggtagcgctctgaagctgagcgaagctggtcataccgtcgcttgccatgatgaaagctttaaacagaaagatgaactggaagcttttgctgaagcctacccacagctgaaaccaatgagcgaacaggaaccagctgaactgatcgaagctgtcaccagcgcttttggtcaggtcgatgtcctggtcagcaacgatatctttgctctagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtactattaccccactgagccgtggaagataaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataatga

SEQ ID NO: 152 - protein, 254 aa, Artificial
  Synthetic Construct
MSTAIVTNVKHFGGMGSALKLSEAGHTVACHDESFKQKDELEAFAEAYPQLKPMSEQEPAELIEAVTSAFGQVDVLVSNDIFALEFQPIDKYAVEDYRGAVEALQIRPFALVNAVASQMKKRKSGHIIFITSAAPFGPWKELSTYTSARAGASTLANALSKELGEYNIPVFAIGPNYLHSEDSPYYYPTEPWKINPEHVAHVKKVTALQRLGTQKELGELVAFLASGSCDYLTGQVFWLAGGFPTIERWPGMPE

SEQ ID NO: 153 - DNA, 768 bp, Artificial
  HHDH
  CDS (1)..(768)
atgagcaccgctatcgtcaccaacgtcaaacattttggaggtatgggtagcgctctgaagctgagcgaagctggtcataccgtcgcttgccatgatgaaagctttaaacagaaagatgaactggaagcttttgctgaaacctttccacagctgaaaccaatgagcgaacaggaaccagctgaactgatcgaagctgtcaccagcgcttttggtcaggtcgatgtcctggtcagcaacgatatctttgctctagaatttcagccaatcgataaatacgctgtcgaagattacaggggtgctgtcgaagctctgcagatcaggccatttgctctagtgaatgctgtggcttcgcaaatgaagatgcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataatga

SEQ ID NO: 154 - protein, 254 aa, Artificial
  Synthetic Construct
MSTAIVTNVKHFGGMGSALKLSEAGHTVACHDESFKQKDELEAFAETFPQLKPMSEQEPAELIEAVTSAFGQVDVLVSNDIFALEFQPIDKYAVEDYRGAVEALQIRPFALVNAVASQMKMRKSGHIIFITSAAPFGPWKELSTYTSARAGASTLANALSKELGEYNIPVFAIGPNYLHSEDSPYYYPTEPWKINPEHVAHVKKVTALQRLGTQKELGELVAFLASGSCDYLTGQVFWLAGGFPTIERWPGMPE

SEQ ID NO: 155 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcggccaatcgataaatacgctgtcgaagattacaggggtgctgtcgaagctctgcagatcaaaccatttgctctagtgaactctgtggcttcccaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactcgggactcaaaaagagttgggggaattggtggcatttttggcatctggctcttgtgattatttgactggccaggtgttttggttggcaggcggctttcccacgatagaacgttggcccggcatgcccgaataatga

SEQ ID NO: 156 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFRPIDKYAVEDYRGAVEALQIKPFALVNSVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPTIERWPGMPE

SEQ ID NO: 157 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcggccaatcgataaatacgctgtcgaagattacaggggtgctgtcgaagctctgcagatcaaaccatttgctctagtgaacgctgtggctccccaaatgaagaagcgaaagtcggggcacatcatcttcatcacttcggcttctccgttcgggccatggaaggagctatcgacttactcttcggctcgagctggggctagtactctagctaatgctctatcgaaggagctaggagagtacaatatcccggtgttcgctatcgggccgaattacctacactcggaggattcgccgtactattaccccactgagccgtggaagattgatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataatga

SEQ ID NO: 158 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFRPIDKYAVEDYRGAVEALQIKPFALVNAVAPQMKKRKSGHIIFITSASPFGPWKELSTYSSARAGASTLANALSKELGEYNIPVFAIGPNYLHSEDSPYYYPTEPWKIDPEHVAHVKKVTALQRLGTQKELGELVAFLASGSCDYLTGQVFWLAGGFPTIERWPGMPE

SEQ ID NO: 159 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcggccaatcgataaatacgctgtcgaagattacaggggtgctgtcgaagctctgcagatcaaaccatttgctctagtgaatgctgtggcttcgcaaatgaagaagcgaaagtcggggcacatcatcttcatcacttcggcttctccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattgatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 160 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFRPIDKYAVEDYRGAVEALQIKPFALVNAVASQMKKRKSGHIIFITSASPFGPWKELSTYSSARAGASALANALSKELGEYNIPVFAIGPNYLHSEDSPYYYPTEPWKIDPEHVAHVKKVTALQRLGTQKELGELVAFLASGSCDYLTGQVFWLAGGFPVIERWPGMPE

SEQ ID NO: 161 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcggccaatcgataaatacgctgtcgaagattacaggggtgctgtcgaagctctgcagatcaaaccatttgctctagtgaacgctgtggctcaccaaatgaagaggcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtactattaccccactgagccgtggaagattgatccggagcacgtggctcacgtgaagaaggtgactgctctacaacgactagggactcaaaaagagttgggggaattggtggcatttttggcatctggcccttgtgattatttgactggccaggtgttttggttggcaggcggctttcccacgatagaacgttggcccggcatgcccgaataatga

SEQ ID NO: 162 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFRPIDKYAVEDYRGAVEALQIKPFALVNAVAHQMKRRKSGHIIFITSAAPFGPWKELSTYTSARAGASTLANALSKELGEYNIPVFAIGPNYLHSEDSPYYYPTEPWKIDPEHVAHVKKVTALQRLGTQKELGELVAFLASGPCDYLTGQVFWLAGGFPTIERWPGMPE

SEQ ID NO: 163 - DNA, 768 bp, Artificial
  HHDH
  CDS (1)..(768)
atgagcactgcgattgttactaacgtcaaacatttcggtggtatggggagtgcgctgcgcctgtcggaggccggtcatacagtagcgtgtcacgatgaaagtttcaaacaaaaggacgaattggaagcctttgcggaaacttacccacagctgaaaccgatgtcagaacaggagccagcggagttaattgaggcggtcaccagtgccttcggccaggtggatgtcctggttagcaacgacatctttgctctggaattccgtccgattgacaagtatgccgtcgaagactaccgtggtgcggtagaagcactgcagatccgcccgttcgcgttggttaatgccgtagctagtcaaatgaaaaaacgtaaatcaggtcatattatcttcattactagcgcgagcccgtttggtccatggaaggagctgtcgacttatagtagtgcgcgcgccggggcctccaccttggctaacgcactgagtaaagaattaggtgagtataatatccctgttttcgccattgggccaaactatctgcactcagaagatagcccatactattacccaacggaaccgtggaagatcaaccctgaacatgtggcgcatgttaaaaaagtaacagccttacaacgtctgggtactcaaaaagaacttggcgagctggttgcgtttctcgcttctggtagctgcgattacttgaccggccaagtcttctggttagccggtggctttccgactattgagcgctggccaggtatgccggaataatga

SEQ ID NO: 164 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFRPIDKYAVEDYRGAVEALQIRPFALVNAVASQMKKRKSGHIIFITSASPFGPWKELSTYSSARAGASTLANALSKELGEYNIPVFAIGPNYLHSEDSPYYYPTEPWKINPEHVAHVKKVTALQRLGTQKELGELVAFLASGSCDYLTGQVFWLAGGFPTIERWPGMPE

SEQ ID NO: 165 - DNA, 768 bp, Artificial
  HHDH
  CDS (1)..(768)
atgagcactgcgattgttactaacgtcaaacatttcggtggtatggggagtgcgctgcgcctgtcggaggccggtcatacagtagcgtgtcacgatgaaagtttcaaacaaaaggacgaattggaagcctttgcggaaacttacccacagctgaaaccgatgtcagaacaggagccagcggagttaattgaggcggtcaccagtgccttcggccaggtggatgtcctggttagcaacgacatctttgctctggaattccgtccgattgacaagtatgccgtcgaagactaccgtggtgcggtagaagcactgcagatcaagccgttcgcgttggttaatgccgtagctagtcaaatgaaaaaacgtaaatcaggtcatattatcttcattactagcgcggctccgtttggtccatggaaggagctgtcgacttatagtagtgcgcgcgccggggcctccaccttggctaacgcactgagtaaagaattaggtgagtataatatccctgttttcgccattgggccaaactatctgcactcagaagatagcccatactattacccaacggaaccgtggaagatcaaccctgaacatgtggcgcatgttaaaaaagtaacagccttacaacgtctgggtactcaaaaagaacttggcgagctggttgcgtttctcgcttctggtagctgcgattacttgaccggccaagtcttctggttagccggtggctttccggtgattgagcgctggccaggtatgccggaataatga

SEQ ID NO: 166 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGASTLANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 167 - DNA, 768 bp, Artificial
  HHDH
  CDS (1)..(768)
atgagcactgcgattgttactaacgttaaacatttcggtggtatggggagtgcgctgaaactgtcggaggccggtcatacagtagcgtgtcacgatgaaagtttcaaacaaaaggacgaattggaagcctttgcggaaacttacccacagctgaaaccgatgtcagaacaggagccagcggagttaattgaggcggtcaccagtgccttcggccaggtggatgtcctggttagcaacgacatctttgctctggaattccgtccgattgacaagtatgccgtcgaagactaccgtggtgcggtagaagcactgcagatccgcccgttcgcgttggttaatgccgtagctagtcaaatgaaaaaacgtaaatcaggtcatattatcttcattactagcgcggctccgtttggtccatggaaggagctgtcgacttatagtagtgcgcgcgccggggcctccaccttggctaacgcactgagtaaagaattaggtgagtataatatccctgttttcgccattgggccaaactatctgcactcagaagatagcccatactattacccaacggaaccgtggaagatcaaccctgaacatgtggcgcatgttaaaaaagtaacagccttacaacgtctgggtactcaaaaagaacttggcgagctggttgcgtttctcgcttctggtagctgcgattacttgaccggccaagtcttctggttagccggtggctttccggtgattgagcgctggccaggtatgccggaataatga

SEQ ID NO: 168 - protein, 254 aa, Artificial
  Synthetic Construct
MSTAIVTNVKHFGGMGSALKLSEAGHTVACHDESFKQKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASTLANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 169 - DNA, 768 bp, Artificial
  HHDH
  CDS (1)..(768)
atgagcactgcgattgttactaacgtcaaacatttcggtggtatggggagtgcgctgaaactgtcggaggccggtcatacagtagcgtgtcacgatgaaagtttcaaacaaaaggacgaattggaagcctttgcggaaacttacccacagctgaaaccgatgtcagaacaggagccagcggagttaattgaggcggtcaccagtgccttcggccaggtggatgtcctggttagcaacgacatctttgctctggaattccagccgattgacaagtatgccgtcgaagactaccgtggtgcggtagaagcactgcagatcaagccgttcgcgttggttaatgccgtagctagtcaaatgaaaaaacgtaaatcaggtcatattatcttcattactagcgcgagcccgtttggtccatggaaggagctgtcgacttatagtagtgcgcgcgccggggcctccgcgttggctaacgcactgagtaaagaattaggtgagtataatatccctgttttcgccattgggccaaactatctgcactcagaagatagcccatactattacccaacggaaccatggaagatccagcctgaacatgtggcgcatgttaaaaaagtaacagccttacaacgtctgggtactcaaaaagaacttggcgagctggttgcgtttctcgcttctggtagctgcgattacttgaccggccaagtcttctggttagccggtggctttccggtgattgagcgctggccaggtatgccggaataatga

SEQ ID NO: 170 - protein, 254 aa, Artificial
  Synthetic Construct
MSTAIVTNVKHFGGMGSALKLSEAGHTVACHDESFKQKDELEAFAETYPQLKPMSEQEPAELIEAVTSAFGQVDVLVSNDIFALEFQPIDKYAVEDYRGAVEALQIKPFALVNAVASQMKKRKSGHIIFITSASPFGPWKELSTYSSARAGASALANALSKELGEYNIPVFAIGPNYLHSEDSPYYYPTEPWKIQPEHVAHVKKVTALQRLGTQKELGELVAFLASGSCDYLTGQVFWLAGGFPVIERWPGMPE

SEQ ID NO: 171 - DNA, 768 bp, Artificial
  HHDH
  CDS (1)..(768)
atgagcactgcgattgttactaacgtcaaacatttcggtggtatggggagtgcgctgaaactgtcggaggccggtcatacagtagcgtgtcacgatgaaagtttcaaacaaaaggacgaattggaagcctttgcggaaacttacccacagctgaaaccgatgtcagaacaggagccagcggagttaattgaggcggtcaccagtgccttcggccaggtggatgtcctggttagcaacgacatctttgctctggaattccgtccgattgacaagtatgccgtcgaagactaccgtggtgcggtagaagcactgcagatcaagccgttcgcgttggttaatgccgtagctagtcaaatgaaaaaacgtaaatcaggtcatattatcttcattactagcgcggctccgtttggtccatggaaggagctgtcgacttatagtagtgcgcgcgccggggcctccgcgttggctaacgcactgagtaaagaattaggtgagtataatatccctgttttcgccattgggccaaactatctgcactcagaagatagcccatactattacccaacggaaccgtggaagatcaaccctgaacatgtggcgcatgttaaaaaagtaacagccttacaacgtctgggtactcaaaaagaacttggcgagctggttgcgtttctcgcttctggtagctgcgattacttgaccggccaagtcttctggttagccggtggctttccggtgattgagcgctggccaggtatgccggaataatga

SEQ ID NO: 172 - protein, 254 aa, Artificial
  Synthetic Construct
MSTAIVTNVKHFGGMGSALKLSEAGHTVACHDESFKQKDELEAFAETYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 173 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcggccaatcgataaatacgctgtcgaagattacaggggtgctgtcgaagctctgcagatcaaaccatttgctctagtgcactctgtggcttcccaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattgatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 174 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFRPIDKYAVEDYRGAVEALQIKPFALVHSVASQMKKRKSGHIIFITSAAPFGPWKELSTYSSARAGASALANALSKELGEYNIPVFAIGPNYLHSEDSPYYYPTEPWKIDPEHVAHVKKVTALQRLGTQKELGELVAFLASGSCDYLTGQVFWLAGGFPVIERWPGMPE

SEQ ID NO: 175 - DNA, 768 bp, Artificial
  HHDH
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccgagactgggccatggaaggagctatcgacttacacttcggctcgagctggggctagtactctagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataatga

SEQ ID NO: 176 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFALEFQPIDKYAVEDYRGAVEALQIRPFALVNAVASQMKKRKSGHIIFITSAAETGPWKELSTYTSARAGASTLANALSKELGEYNIPVFAIGPNYLHSEDSPYYYPTEPWKINPEHVAHVKKVTALQRLGTQKELGELVAFLASGSCDYLTGQVFWLAGGFPTIERWPGMPE

SEQ ID NO: 177 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 178 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALAKELGEYNIPVFAIGPNYLHSEDSPFYYPTEPWKINPEHVAHVKKVTALQRLGTQKELGELVAFLASGSCDYLTGQVFWLAGGFPVIERWPGMPE

SEQ ID NO: 179 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 180 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPAIERWPGMPE

SEQ ID NO: 181 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctacagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 182 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALAKELGEYNIPVFAIGPNYLHSEDSPFYYPTEPWKINPEHVAHVKKVTALQRLGTQKELGELVAFLASGSCDYLTGQVFWLAGGFPAIERWPGMPE

SEQ ID NO: 183 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagtatgtggctcacgtgaagaaggtgactgctctacgtcgactagggactcaaaaagagttgggggaattggtggcatttttggcatctggctcctgtgattatttgactggccaggtgttttggttggcaggcggctttcccgctatagaacgttggcccggcatgcccgaataatga

SEQ ID NO: 184 - protein, 254 aa, Artificial
  Synthetic Construct
MSTAIVTNVKHFGGMGSALKLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPFYYPTEPWKINPEYVAHVKKVTALRRLGTQKELGELVAFLASGSCDYLTGQVFWLAGGFPAIERWPGMPE

SEQ ID NO: 185 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagtatgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 186 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEYVAHVKKVTALRRLGTQKELGELVAFLASGSCDYLTGQVFWLAGGFPAIERWPGMPE

SEQ ID NO: 187 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgttctattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 188 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALAKELGEYNIPVFAIGPNYLHSEDSPFYYPTEPWKINPEHVAHVKKVTALRRLGTQKELGELVAFLASGSCDYLTGQVFWLAGGFPVIERWPGMPE

SEQ ID NO: 189 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 190 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALAKELGEYNIPVFAIGPNYLHSEDSPYYYPTEPWKINPEHVAHVKKVTALQRLGTQKELGELVAFLASGSCDYLTGQVFWLAGGFPAIERWPGMPE

SEQ ID NO: 191 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 192 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPAIERWPGMPE

SEQ ID NO: 193 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 194 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPAIERWPGMPE

SEQ ID NO: 195 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgccgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 196 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPAIERWPGMPE

SEQ ID NO: 197 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 198 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 199 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 200 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 201 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 202 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 203 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcttggtcagcaacgatatctttgctctagaatttcggccaatcgataaatacgctgtcgaggattacaggggtgctgtcgaagctctgcagatcaggccatttgctctagtgcatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 204 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVHAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 205 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaggatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgcattcggtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtgacatttttggcatctggctcttgtgattatttgactggccaggtgttttggttggcaggcggctttcccgtcatagaacgttggcccggcatgcccgaataatga

SEQ ID NO: 206 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVHSVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVTFLASGSCDYLTGQVFWLAGGFPVIERWPGMPE

SEQ ID NO: 207 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgtttgcccggcatgctggaataatga

SEQ ID NO: 208 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERLPGMLE

SEQ ID NO: 209 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagtatgtggctcacgtgaagaaggtgactgctctacgtcgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 210 - protein, 254 aa, Artificial
  Synthetic Construct
MSTAIVTNVKHFGGMGSALKLSEAGHTVACHDESFKHKDELEAFAETYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGTSALANALSKELGEYNIPVFAIGPNYLHSEDSPFYYPTEPWKINPEYVAHVKKVTALRRLGTQKELGELVAFLASGSCDYLTGQVFWLAGGFPVIERWPGMPE

SEQ ID NO: 211 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 212 - protein, 254 aa, Artificial
  Synthetic Construct
MSTAIVTNVKHFGGMGSALKLSEAGHTVACHDGSFKHKDELEAFAEAYPQLKPMSEQEPAELIEAVTSAFGHVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALRRLGTQKELGELVAFLASGSCDYLTGQVFWLAGGFPVIERWPGMPE

SEQ ID NO: 213 - DNA, 768 bp, Artificial
  HHDH
  CDS (1)..(768)
atgagcaccgctattgtcaccaacgtcaaacattttggaggtatgggcagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaagattacaggggtgctgtcgaagctctgcagatcaagccatttgctctagtgcatgctgtggctccgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcatgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 214 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIKPFALVHAVAPQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 215 - DNA, 768 bp, Artificial; identical to SEQ ID NO: 43
  HHDH
  CDS (1)..(768)

SEQ ID NO: 216 - protein, 254 aa, Artificial; identical to SEQ ID NO: 44
  Synthetic Construct

SEQ ID NO: 217 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 218 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGTSALANALAKELGEYNIPVFAIGPNYLHSEDSPFYYPTEPWKINPEHVAHVKKVTALQRLGTQKELGELVAFLASGSCDYLTGQVFWLAGGFPVIERWPGMLE

SEQ ID NO: 219 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgagaactacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 220 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVENYRGAVEALQIRPFALVNAVASQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPAIERWPGMLE

SEQ ID NO: 221 - DNA, 768 bp, Artificial
  CDS
  CDS (1)..(768)
atgagcaccgctattgtcaccaacgtcaaacattttggaggtatgggtagcgctctgaggctgagcgaagctggtcataccgtcgcttgccatgatggtagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctacaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 222 - protein, 254 aa, Artificial
  Synthetic Construct
MSTAIVTNVKHFGGMGSALRLSEAGHTVACHDGSFKHKDELEAFAETYPQLKPMSEQEPAELIEAVTSAFGQVDVLVSNDIFALQFRPIDKYAVEDYRGAVEALQIKPFALVNAVASQMKKRKSGHIIFITSAAPFGPWKELSTYSSARAGTSALANALAKELGEYNIPVFAIGPNYLHSEDSPFYYPTEPWKINPEHVAHVKKVTALQRLGTQKELGELVAFLASGSCDYLTGQVFWLAGGFPAIERWPGMLE

SEQ ID NO: 223 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgcatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 224 - protein, 254 aa, Artificial
  Synthetic Construct
MSTAIVTNVKHFGGMGSALKLSEAGHTVACHDGSFKHKDELEAFAEAYPQLKPMSEQEPAELIEAVTSAFGQVDVLVSNDIFALEFRPIDKYAVEDYRGAVEALQIRPFALVHAVASQMKKRKSGHIIFITSAAPFGPWKELSTYSSARAGASALANALSKELGEYNIPVFAIGPNYLHSEDSPYYYPTEPWKINPEHVAHVKKVTALRRLGTQKELGELVAFLASGSCDYLTGQVFWLAGGFPAIERWPGMPE

SEQ ID NO: 225 - DNA, 768 bp, Artificial
  HHDH
  CDS (1)..(768)
atgagcaccgctattgtcaccaacgtcaaacattttggtggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 226 - protein, 254 aa, Artificial; identical to SEQ ID NO: 98
  Synthetic Construct

SEQ ID NO: 227 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatggtagctttaagcataaagatgaactggaagcttttgctgaaacctacccacagctgaaaccaatgaccgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 228 - protein, 254 aa, Artificial
  Synthetic Construct
MSTAIVTNVKHFGGMGSALRLSEAGHTVACHDGSFKHKDELEAFAETYPQLKPMTEQEPAELIEAVTSAFGQVDVLVSNDIFALEFRPIDKYAVEDYRGAVEALQIRPFALVNAVAPQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPAIERWPGMPE

SEQ ID NO: 229 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 230 - protein, 254 aa, Artificial
  Synthetic Construct
MSTAIVTNVKHFGGMGSALKLSEAGHTVACHDESFKHKDELEAFAEAYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPVIERWPGMPE

SEQ ID NO: 231 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagtatgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 232 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGHVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEYVAHVKKVTALRRLGTQKELGELVAFLASGSCDYLTGQVFWLAGGFPAIERWPGMLE

SEQ ID NO: 233 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaagccatttgctctagtgaatgctgtggctccacaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 234 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGHVDVLVSNDIFALEFRPIDKYAVEDYRGAVEALQIKPFALVNAVAPQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 235 - DNA, 768 bp, Artificial
  HHDH
  CDS (1)..(768)
atgaacaccgttattgtcaccaacgtcaaacattttggaggtatgggtagcgctttgaaactgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 236 - protein, 254 aa, Artificial
  Synthetic Construct
MNTVIVTNVKHFGGMGSALKLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 237 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 238 - protein, 254 aa, Artificial
  Synthetic Construct
MSTAIVTNVKHFGGMGSALKLSEAGHTVACHDESFKHKDELEAFAETYPQLKPMSEQEPAELIEAVTSAFGHVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 239 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcctttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 240 - protein, 254 aa, Artificial
  Synthetic Construct
MSTAIVTNVKHFGGMGSALKLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 241 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 242 - protein, 254 aa, Artificial; identical to SEQ ID NO: 240
  Synthetic Construct

SEQ ID NO: 243 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatggccgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcagctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 244 - protein, 254 aa, Artificial
  Synthetic Construct
MSTAIVTNVKHFGGMGSALKLSEAGHTVACHDESFKHKDELEAFAETYPQLKPMAEQEPAELIEAVTSAFGHVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 245 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccactgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 246 - protein, 254 aa, Artificial
  Synthetic Construct
MSTAIVTNVKHFGGMGSALKLSEAGHTVACHDESFKHKDELEAFAETYPQLKPLSEQEPAELIEAVTSAFGHVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 247 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgcaatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 248 - protein, 254 aa, Artificial; identical to SEQ ID NO: 238
  Synthetic Construct

SEQ ID NO: 249 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 250 - protein, 254 aa, Artificial
  Synthetic Construct
MSTAIVTNVKHFGGMGSALKLSEAGHTVACHDGSFKHKDELEAFAETYPQLKPMSEQEPAELIEAVTSAFGHVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 251 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgcagtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagtatgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 252 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPFYYPTEPWKINPEYVAHVKKVTALQRLGTQKELGELVAFLASGSCDYLTGQVFWLAGGFPAIERWPGMPE

SEQ ID NO: 253 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacgatatcccggtgttcgctatcgggccgaattacctacactcggaggattcgccgttctattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 254 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYDIPVFAIGPNYLHSEDSPFYYPTEPWKINPEHVAHVKKVTALRRLGTQKELGELVAFLASGSCDYLTGQVFWLAGGFPAIERWPGMPE

SEQ ID NO: 255 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgggcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgtactattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 256 - protein, 254 aa, Artificial
  Synthetic Construct
MSTAIVTNVKHFGGMGSALRLSEAGHTVACHDESFKHKDELEAFAEAYPQLKPMGEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALAKELGEYNIPVFAIGPNYLHSEDSPYYYPTEPWKINPEHVAHVKKVTALRRLGTQKELGELVAFLASGSCDYLTGQVFWLAGGFPAIERWPGMPE

SEQ ID NO: 257 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgagaactacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 258 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVENYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 259 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcgtccaatcgataaatactcagtcgagaactacaggggtgctgtcgaagctctgcagatcaggccatttgctctagtgaattcggtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaggagttgggggaattggtggcatttttggcatctggctcttgtgattatttgactggccaggtgttttggttggcaggcggctttcccgtcatagaacgttggcccggcatgcccgaataatga

SEQ ID NO: 260 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVENYRGAVEALQIRPFALVNSVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 261 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 262 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 263 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgagaactacaggggtgctgtcgaagctctgcagatcagaccatttgctctagtgcatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 264 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVENYRGAVEALQIRPFALVHAVAPQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 265 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgatggcccgacatgctggaataatga

SEQ ID NO: 266 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPDMLE

SEQ ID NO: 267 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctacaatttcgtccaatcgataaatactcagtcgagaactacaggggtgctgtcgaagctctgcagatcaggccatttgctctagtgaattcggtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 268 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALQFRPIDKYSVENYRGAVEALQIRPFALVNSVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 269 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgaggattacaggggtgctgtcgaagctctgcagatcaggccatttgctctagtgaatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgccggaataatga

SEQ ID NO: 270 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVEDYRGAVEALQIRPFALVNAVAPQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 271 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgcattcggtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 272 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVHSVASQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPAIERWPGMLE

SEQ ID NO: 273 - DNA, 768 bp, Artificial
  HHDH
  CDS (1)..(768)
atgaacaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccactgagcgaacaagaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 274 - protein, 254 aa, Artificial
  Synthetic Construct
MNTAIVTNVKHFGGMGSALKLSEAGHTVACHDESFKHKDELEAFAEAYPQLKPLSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPAIERWPGMPE

SEQ ID NO: 275 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatggtagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctacaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgttctattaccccactgagccgtggaagattaatccggagtatgtggctcacgtgaagaaggtgactgctctacgtcgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 276 - protein, 254 aa, Artificial
  Synthetic Construct
MSTAIVTNVKHFGGMGSALRLSEAGHTVACHDGSFKHKDELEAFAETYPQLKPMSEQEPAELIEAVTSAFGQVDVLVSNDIFALQFRPIDKYAVEDYRGAVEALQIRPFALVNAVASQMKKRKSGHIIFITSAAPFGPWKELSTYSSARAGTSALANALAKELGEYNIPVFAIGPNYLHSEDSPFYYPTEPWKINPEYVAHVKKVTALRRLGTQKELGELVAFLASGSCDYLTGQVFWLAGGFPVIERWPGMPE

SEQ ID NO: 277 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatggccgaacaggaaccagctgaactgattgaagctgtcaccagcgcttttggtcaggtcgatgtcctggtcagcaacgatatctttgctctagaatttcggccaatcgataaatactcagtcgaggattacaggggtgctgtcgaagctctgcagatcaagccatttgctctagtgaattcggtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 278 - protein, 254 aa, Artificial
  Synthetic Construct
MSTAIVTNVKHFGGMGSALKLSEAGHTVACHDESFKHKDELEAFAEAYPQLKPMAEQEPAELIEAVTSAFGQVDVLVSNDIFALEFRPIDKYSVEDYRGAVEALQIKPFALVNSVAPQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPAIERWPGMLE

SEQ ID NO: 279 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaagcctacccacagctgaaaccaatggccgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 280 - protein, 254 aa, Artificial
  Synthetic Construct
MSTAIVTNVKHFGGMGSALKLSEAGHTVACHDGSFKHKDELEAFAEAYPQLKPMAEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 281 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgttgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 282 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGVVEALQIKPFALVNAVASQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPAIERWPGMLE

SEQ ID NO: 283 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatactcagtcgaggattacaggggtgctgtcgaagctctgcagatcaggccatttgctctagtgaattcggtggctccacaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 284 - protein, 254 aa, Artificial
  Synthetic Construct
MSTAIVTNVKHFGGMGSALKLSEAGHTVACHDESFKHKDELEAFAETYPQLKPMSEQEPAELIEAVTSAFGHVDVLVSNDIFALEFRPIDKYSVEDYRGAVEALQIRPFALVNSVAPQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPAIERWPGMLE

SEQ ID NO: 285 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatggtagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggtatgctggaataatga

SEQ ID NO: 286 - protein, 254 aa, Artificial
  Synthetic Construct
MSTAIVTNVKHFGGMGSALRLSEAGHTVACHDGSFKHKDELEAFAEAYPQLKPMSEQEPAELIEAVTSAFGHVDVLVSNDIFALEFRPIDKYAVEDYRGAVEALQIKPFALVNAVASQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPVIERWPGMLE

SEQ ID NO: 287 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaatgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 288 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGHVDVLVSNDIFALEFRPIDKYAVEDYRGAVEALQIKPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPAIERWPGMLE

SEQ ID NO: 289 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatggccgaacaggaaccagctgaactgattgaagctgtcaccagcgcttttggtcatgtcgatgtcctggtcagcaacgatatctttgctctagaatttcgtccaatcgataaatacgctgtcgaggattacaggggtgctgtcgaagctctgcagatcaggccatttgctctagtgaatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagtatgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 290 - protein, 254 aa, Artificial
  Synthetic Construct
MSTAIVTNVKHFGGMGSALKLSEAGHTVACHDESFKHKDELEAFAEAYPQLKPMAEQEPAELIEAVTSAFGHVDVLVSNDIFALEFRPIDKYAVEDYRGAVEALQIRPFALVNAVAPQMKKRKSGHIIFITSAAPFGPWKELSTYSSARAGASALANALSKELGEYNIPVFAIGPNYLHSEDSPYYYPTEPWKINPEYVAHVKKVTALRRLGTQKELGELVAFLASGSCDYLTGQVFWLAGGFPAIERWPGMPE

SEQ ID NO: 291 - DNA, 768 bp, Artificial
  HHDH
  CDS (1)..(768)
atgaacaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatggccgaacaggaaccagctgaactgattgaagctgtcaccagcgcttttggtcatgtcgatgtcctggtcagcaacgatatctttgctctagaatttcgtccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagtacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 292 - protein, 254 aa, Artificial
  Synthetic Construct
MNTAIVTNVKHFGGMGSALKLSEAGHTVACHDESFKHKDELEAFAETYPQLKPMAEQEPAELIEAVTSAFGHVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPFYYPTEPWKINPEYVAHVKKVTALQRLGTQKELGELVAFLASGSCDYLTGQVFWLAGGFPAIERWPGMPE

SEQ ID NO: 293 - DNA, 768 bp, Artificial
  HHDH
  CDS (1)..(768)
atgagcaccgttattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccactgagcgaacaggaaccagctgaactgattgaagctgtcaccagcgcttttggtcaggtcgatgtcctggtcagcaacgatatctttgctctagaatttcgtccaatcgataaatactcagtcgaggattacaggggtgctgtcgaagctctgcagatcaggccatttgctctagtgcattcggtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgaccggccaggtgttttggttggcaggcggctttcccgctatagaacgttggcccggcatgctggaataatga

SEQ ID NO: 294 - protein, 254 aa, Artificial
  Synthetic Construct
MSTVIVTNVKHFGGMGSALRLSEAGHTVACHDESFKHKDELEAFAEAYPQLKPLSEQEPAELIEAVTSAFGQVDVLVSNDIFALEFRPIDKYSVEDYRGAVEALQIRPFALVHSVASQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPAIERWPGMLE

SEQ ID NO: 295 - DNA, 768 bp, Artificial
  HHDH
  CDS (1)..(768)
atgaacaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatactcagtcgaggattacaggggtgctgtcgaagctctgcagatcaggccatttgctctagtgaatgctgtggctccacaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 296 - protein, 254 aa, Artificial
  Synthetic Construct
MNTAIVTNVKHFGGMGSALRLSEAGHTVACHDESFKHKDELEAFAEAYPQLKPMSEQEPAELIEAVTSAFGHVDVLVSNDIFALEFRPIDKYSVEDYRGAVEALQIRPFALVNAVAPQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPAIERWPGMLE

SEQ ID NO: 297 - DNA, 774 bp, Artificial
  HHDH
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgacctgattgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccataatagaacgttggcccggcatgcccgaataatgaggatcc

SEQ ID NO: 298 - protein, 254 aa, Artificial; identical to SEQ ID NO: 42
  Synthetic Construct

SEQ ID NO: 299 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgaggattacaggggtgctgtcgaagctctgcagatcaggccatttgctctagtgcatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 300 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVEDYRGAVEALQIRPFALVHAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 301 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgcatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 302 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVHAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 303 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgagaactacaggggtgctgtcgaagctctgcagatccgcccatttgctctagtgaatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggctggcaggcggctttcccgtcatagaacgttggcccggcatgcccgaataatga

SEQ ID NO: 304 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGHVDVLVSNDIFALEFRPIDKYAVENYRGAVEALQIRPFALVNAVAPQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPVIERWPGMPE

SEQ ID NO: 305 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatggccgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 306 - protein, 254 aa, Artificial
  Synthetic Construct
MSTAIVTNVKHFGGMGSALRLSEAGHTVACHDESFKHKDELEAFAEAYPQLKPMAEQEPAELIEAVTSAFGQVDVLVSNDIFALEFRPIDKYAVEDYRGAVEALQIRPFALVNAVAPQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPVIERWPGMPE

SEQ ID NO: 307 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 308 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPAIERWPGMPE

SEQ ID NO: 309 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 310 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGHVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 311 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccactgaccgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 312 - protein, 254 aa, Artificial
  Synthetic Construct
MSTAIVTNVKHFGGMGSALRLSEAGHTVACHDESFKHKDELEAFAETYPQLKPLTEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 313 - DNA, 768 bp, Artificial
  HHDH
  CDS (1)..(768)
atgagcaccgctattgtcaccaacgtcaaacattttggaggtatgggtagcgctctgaaactgagcgaagttggtcataccgtcgcttgccatgatgaaagctttaagcataaagatgaactggaagcttttgctgaaacctacccacagctgaaaccactggccgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 314 - protein, 254 aa, Artificial
  Synthetic Construct
MSTAIVTNVKHFGGMGSALKLSEVGHTVACHDESFKHKDELEAFAETYPQLKPLAEQEPAELIEAVTSAFGHVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 315 - DNA, 768 bp, Artificial; identical to SEQ ID NO: 281
  HHDH
  CDS (1)..(768)

SEQ ID NO: 316 - protein, 254 aa, Artificial; identical to SEQ ID NO: 282
  Synthetic Construct

SEQ ID NO: 317 - DNA, 768 bp, Artificial; identical to SEQ ID NO: 237
  HHDH
  CDS (1)..(768)

SEQ ID NO: 318 - protein, 254 aa, Artificial; identical to SEQ ID NO: 238
  Synthetic Construct

SEQ ID NO: 319 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcgtccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctctcccgtcatagaacgttggcccggcatgctggaataatga

SEQ ID NO: 320 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGSPVIERWPGMLE

SEQ ID NO: 321 - DNA, 768 bp, Artificial
  HHDH
  HHDH (1)..(768)
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccactggccgaacaggaaccagctgaactgattgaagctgtcaccagcgcttttggtcaggtcgatgtcctggtcagcaacgatatctttgctctagaatttcggccaatcgataaatactcagtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtgggagattaatccggagtatgtggctcacgtgaagaaggtgactgctctacgtcgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 322 - protein, 254 aa, Artificial
  Synthetic Construct
MSTAIVTNVKHFGGMGSALKLSEAGHTVACHDESFKHKDELEAFAETYPQLKPLAEQEPAELIEAVTSAFGQVDVLVSNDIFALEFRPIDKYSVEDYRGAVEALQIRPFALVNAVASQMKKRKSGHIIFITSAAPFGPWKELSTYSSARAGASALANALSKELGEYNIPVFAIGPNYLHSEDSPYYYPTEPWEINPEYVAHVKKVTALRRLGTQKELGELVAFLASGSCDYLTGQVFWLAGGFPVIERWPGMPE

SEQ ID NO: 323 - DNA, 768 bp, Artificial; identical to SEQ ID NO: 189
  HHDH
  CDS (1)..(768)

SEQ ID NO: 324 - protein, 254 aa, Artificial; identical to SEQ ID NO: 190
  Synthetic Construct

SEQ ID NO: 325 - DNA, 768 bp, Artificial; identical to SEQ ID NO: 191
  HHDH
  CDS (1)..(768)

SEQ ID NO: 326 - protein, 254 aa, Artificial; identical to SEQ ID NO: 192
  Synthetic Construct

SEQ ID NO: 327 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 328 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPAIERWPGMPE

SEQ ID NO: 329 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaagcctacccacagctgaaaccaatggccgaacaggaaccagctgaactgattgaagctgtcaccagcgcttttggtcatgtcgatgtcctggtcagcaacgatatctttgctctagaatttcggccaatcgataaatactcagtcgaggattacaggggtgctgtcgaagctctgcagatcaggccatttgctctagtgcatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 330 - protein, 254 aa, Artificial
  Synthetic Construct
MSTAIVTNVKHFGGMGSALKLSEAGHTVACHDGSFKHKDELEAFAEAYPQLKPMAEQEPAELIEAVTSAFGHVDVLVSNDIFALEFRPIDKYSVEDYRGAVEALQIRPFALVHAVASQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPVIERWPGMPE

SEQ ID NO: 331 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccactggccgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 332 - protein, 254 aa, Artificial
  Synthetic Construct
MSTAIVTNVKHFGGMGSALRLSEAGHTVACHDESFKHKDELEAFAETYPQLKPLAEQEPAELIEAVTSAFGQVDVLVSNDIFALEFRPIDKYAVEDYRGAVEALQIRPFALVNAVAPQMKKRKSGHIIFITSAAPFGPWKELSTYSSARAGASALANALSKELGEYNIPVFAIGPNYLHSEDSPFYYPTEPWKINPEHVAHVKKVTALRRLGTQKELGELVAFLASGSCDYLTGQVFWLAGGFPVIERWPGMPE

SEQ ID NO: 333 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccactgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 334 - protein, 254 aa, Artificial
  Synthetic Construct
MSTAIVTNVKHFGGMGSALKLSEAGHTVACHDESFKHKDELEAFAETYPQLKPLSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 335 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgcatgctgtggctccacaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 336 - protein, 254 aa, Artificial
  Synthetic Construct
MSTAIVTNVKHFGGMGSALKLSEAGHTVACHDESFKHKDELEAFAETYPQLKPMSEQEPAELIEAVTSAFGQVDVLVSNDIFALEFRPIDKYAVEDYRGAVEALQIRPFALVHAVAPQMKKRKSGHIIFITSAAPFGPWKELSTYSSARAGTSALANALSKELGEYNIPVFAIGPNYLHSEDSPFYYPTEPWKINPEHVAHVKKVTALRRLGTQKELGELVAFLASGSCDYLTGQVFWLAGGFPAIERWPGMLE

SEQ ID NO: 337 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgagaactacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 338 - protein, 254 aa, Artificial
  Synthetic Construct
MSTAIVTNVKHFGGMGSALKLSEAGHTVACHDGSFKHKDELEAFAETYPQLKPMSEQEPAELIEAVTSAFGQVDVLVSNDIFALEFRPIDKYSVENYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPAIERWPGMPE

SEQ ID NO: 339 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccactggccgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctggaactagtgcactagctaatgctctagctaaggagctaggagagtacaatatcccggtgttcgctatcgggccgaattacctacactcggaggattcgccgtactattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 340 - protein, 254 aa, Artificial
  Synthetic Construct
MSTAIVTNVKHFGGMGSALRLSEAGHTVACHDESFKHKDELEAFAEAYPQLKPLAEQEPAELIEAVTSAFGHVDVLVSNDIFALEFRPIDKYAVEDYRGAVEALQIRPFALVNAVASQMKKRKSGHIIFITSAAPFGPWKELSTYSSARAGTSALANALAKELGEYNIPVFAIGPNYLHSEDSPYYYPTEPWKINPEHVAHVKKVTALRRLGTQKELGELVAFLASGSCDYLTGQVFWLAGGFPVIERWPGMLE

SEQ ID NO: 341 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 342 - protein, 254 aa, Artificial
  Synthetic Construct
MSTAIVTNVKHFGGMGSALKLSEAGHTVACHDGSFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPFYYPTEPWKINPEHVAHVKKVTALRRLGTQKELGELVAFLASGSCDYLTGQVFWLAGGFPAIERWPGMPE

SEQ ID NO: 343 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgttctattaccccactgagccgtggaagattaatccggagtatgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 344 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALAKELGEYNIPVFAIGPNYLHSEDSPFYYPTEPWKINPEYVAHVKKVTALQRLGTQKELGELVAFLASGSCDYLTGQVFWLAGGFPAIERWPGMPE

SEQ ID NO: 345 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcgggcggctttcccgctatagaacgttggcccggcatgcccgaataatga

SEQ ID NO: 346 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALRRLGTQKELGELVAFLASGSCDYLTGQVFWLAGGFPAIERWPGMPE

SEQ ID NO: 347 - DNA, 768 bp, Artificial; identical to SEQ ID NO: 179
  HHDH
  CDS (1)..(768)

SEQ ID NO: 348 - protein, 254 aa, Artificial; identical to SEQ ID NO: 180
  Synthetic Construct

SEQ ID NO: 349 - DNA, 768 bp, Artificial; identical to SEQ ID NO: 197
  HHDH
  CDS (1)..(768)

SEQ ID NO: 350 - protein, 254 aa, Artificial; identical to SEQ ID NO: 198
  Synthetic Construct

SEQ ID NO: 351 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgccgtggcttcgcaaatgaagaagcgaaagtcggggcacatcatcttcatcacttcggctgccccgttcgggccatggaaggagctatcgacttactcttcggctcgagctggggctagtgcactagctaatgctctagctaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 352 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALAKELGEYNIPVFAIGPNYLHSEDSPFYYPTEPWKINPEHVAHVKKVTALQRLGTQKELGELVAFLASGSCDYLTGQVFWLAGGFPAIERWPGMPE

SEQ ID NO: 353 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccactgagcgaacaggaaccagctgaactgattgaagctgtcaccagcgcttttggtcaggtcgatgtcctggtcagcaacgatatctttgctctacaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagtatgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 354 - protein, 254 aa, Artificial
  Synthetic Construct
MSTAIVTNVKHFGGMGSALKLSEAGHTVACHDESFKHKDELEAFAEAYPQLKPLSEQEPAELIEAVTSAFGQVDVLVSNDIFALQFRPIDKYAVEDYRGAVEALQIRPFALVNAVASQMKKRKSGHIIFITSAAPFGPWKELSTYSSARAGTSALANALSKELGEYNIPVFAIGPNYLHSEDSPFYYPTEPWKINPEYVAHVKKVTALQRLGTQKELGELVAFLASGSCDYLTGQVFWLAGGFPVIERWPGMPE

SEQ ID NO: 355 - DNA, 768 bp, Artificial
  HHDH
  CDS (1)..(768)
atgagcaccgctattgtcaccaacgtcaaacattttgaaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 356 - protein, 254 aa, Artificial
  Synthetic Construct
MSTAIVTNVKHFEGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 357 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgagaactacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagtatgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 358 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYSVENYRGAVEALQIRPFALVNAVASQMKKRKSGHIIFITSAAPFGPWKELSTYSSARAGASALANALSKELGEYNIPVFAIGPNYLHSEDSPFYYPTEPWKINPEYVAHVKKVTALQRLGTQKELGELVAFLASGSCDYLTGQVFWLAGGFPVIERWPGMLE

SEQ ID NO: 359 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgagaactacaggggtgctgtcgaagctctgcagatcaggccatttgctctagtgcatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 360 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVENYRGAVEALQIRPFALVHAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 361 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgacgcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacgtcgactagggactcagaaagagttgggggaattggtggcatttttggcatctggctcttgtgattatttgactggccaggtgttttggttggcaggcggctttcccgtcatagaacgttggcccggcatgcccgaataatga

SEQ ID NO: 362 - protein, 254 aa, Artificial
  Synthetic Construct
MSTAIVTNVKHFGGMGSALRLSEAGHTVACHDESFKHKDELEAFADAYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPFYYPTEPWKINPEHVAHVKKVTALRRLGTQKELGELVAFLASGSCDYLTGQVFWLAGGFPVIERWPGMPE

SEQ ID NO: 363 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatggccgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaattcggtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 364 - protein, 254 aa, Artificial
  Synthetic Construct
MSTAIVTNVKHFGGMGSALKLSEAGHTVACHDESFKHKDELEAFAEAYPQLKPMAEQEPAELIEAVTSAFGQVDVLVSNDIFALEFRPIDKYAVEDYRGAVEALQIRPFALVNSVAPQMKKRKSGHIIFITSAAPFGPWKELSTYSSARAGASALANALSKELGEYNIPVFAIGPNYLHSEDSPFYYPTEPWKINPEHVAHVKKVTALQRLGTQKELGELVAFLASGSCDYLTGQVFWLAGGFPVIERWPGMLE

SEQ ID NO: 365 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaattcggtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 366 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNSVAPQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 367 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctatcgaggattacaggggtgctgtcgaagctctgcagatcaggccatttgctctagtgcatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 368 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAIEDYRGAVEALQIRPFALVHAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 369 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatggtagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatactcagtcgaggattacaggggtgctgtcgaagctctgcagatcaggccatttgctctagtgaatgctgtggctccacaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgagtaatga

SEQ ID NO: 370 - protein, 254 aa, Artificial
  Synthetic Construct
MSTAIVTNVKHFGGMGSALRLSEAGHTVACHDGSFKHKDELEAFAEAYPQLKPMSEQEPAELIEAVTSAFGHVDVLVSNDIFALEFRPIDKYSVEDYRGAVEALQIRPFALVNAVAPQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPVIERWPGMPE

SEQ ID NO: 371 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgtcatgatggtagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagtatgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 372 - protein, 254 aa, Artificial
  Synthetic Construct
MSTAIVTNVKHFGGMGSALRLSEAGHTVACHDGSFKHKDELEAFAEAYPQLKPMSEQEPAELIEAVTSAFGQVDVLVSNDIFALEFRPIDKYSVEDYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEYVAHVKKVTALRRLGTQKELGELVAFLASGSCDYLTGQVFWLAGGFPAIERWPGMPE

SEQ ID NO: 373 - DNA, 768 bp, Artificial
  HHDH
  CDS (1)..(768)
atgagcaccgctattgtcaccaacgtcaaacattttgggggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 374 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGHVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPVIERWPGMLE

SEQ ID NO: 375 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatactcagtcgaggattacaggggtgctgtcgaagctctgcagatccgcccatttgctctagtgcatgcggtggctccacaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcagaaagagttgggggaattggtggcatttttggcatctggctcttgtgattatttgactggccaggtgttttggttggcaggcggctttcccgctatagaacgttggcccggcatgcccgaataatga

SEQ ID NO: 376 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGHVDVLVSNDIFALEFRPIDKYSVEDYRGAVEALQIRPFALVHAVAPQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPAIERWPGMPE

SEQ ID NO: 377 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 378 - protein, 254 aa, Artificial; identical to SEQ ID NO: 182
  Synthetic Construct

SEQ ID NO: 379 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgttctattaccccactgagccgtggaggattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 380 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPFYYPTEPWRINPEHVAHVKKVTALQRLGTQKELGELVAFLASGSCDYLTGQVFWLAGGFPAIERWPGMPE

SEQ ID NO: 381 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctacaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 382 - protein, 254 aa, Artificial
  Synthetic Construct
MSTAIVTNVKHFGGMGSALKLSEAGHTVACHDESFKHKDELEAFAEAYPQLKPMSEQEPAELIEAVTSAFGHVDVLVSNDIFALQFRPIDKYAVEDYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALRRLGTQKELGELVAFLASGSCDYLTGQVFWLAGGFPAIERWPGMPE

SEQ ID NO: 383 - DNA, 768 bp, Artificial; identical to SEQ ID NO: 241
  HHDH
  CDS (1)..(768)

SEQ ID NO: 384 - protein, 254 aa, Artificial; identical to SEQ ID NO: 240
  Synthetic Construct

SEQ ID NO: 385 - DNA, 768 bp, Artificial; identical to SEQ ID NO: 289
  HHDH
  CDS (1)..(768)

SEQ ID NO: 386 - protein, 254 aa, Artificial; identical to SEQ ID NO: 290
  Synthetic Construct

SEQ ID NO: 387 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcgaccaatcgataaatacgctgtcgagaattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatctgactggccaggtgttttggttggcaggcggctttcccgtcatagaacgttggcccggcatgcccgaataatga

SEQ ID NO: 388 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVENYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 389 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatgaccgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 390 - protein, 254 aa, Artificial
  Synthetic Construct
MSTAIVTNVKHFGGMGSALKLSEAGHTVACHDESFKHKDELEAFAEAYPQLKPMTEQEPAELIEAVTSAFGQVDVLVSNDIFALEFRPIDKYAVEDYRGAVEALQIKPFALVNAVASQMKKRKSGHIIFITSAAPFGPWKELSTYSSARAGASALANALSKELGEYNIPVFAIGPNYLHSEDSPYYYPTEPWKINPEHVAHVKKVTALRRLGTQKELGELVAFLASGSCDYLTGQVFWLAGGFPAIERWPGMLE

SEQ ID NO: 391 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 392 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPAIERWPGMPE

SEQ ID NO: 393 - DNA, 768 bp, Artificial; identical to SEQ ID NO: 245
  HHDH
  CDS (1)..(768)

SEQ ID NO: 394 - protein, 254 aa, Artificial; identical to SEQ ID NO: 246
  Synthetic Construct

SEQ ID NO: 395 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcgaccaatcgataaatacgctgtcgaggattacaggggtgctgtcgaagctctgcagatcaagccatttgctctagtgaattcggtggcttcgcaaatgaagaagcgaaagtcggggcacatcatcttcatcacttcggctgccccgttcgggccatggaaggagctatcgacttactcttcggctcgagctggggctagtgcactagctaatgctctagctaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 396 - protein, 254 aa, Artificial
  Synthetic Construct
MSTAIVTNVKHFGGMGSALKLSEAGHTVACHDESFKHKDELEAFAETYPQLKPMSEQEPAELIEAVTSAFGQVDVLVSNDIFALEFRPIDKYAVEDYRGAVEALQIKPFALVNSVASQMKKRKSGHIIFITSAAPFGPWKELSTYSSARAGASALANALAKELGEYNIPVFAIGPNYLHSEDSPYYYPTEPWKINPEHVAHVKKVTALQRLGTQKELGELVAFLASGSCDYLTGQVFWLAGGFPAIERWPGMLE

SEQ ID NO: 397 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgcattcggtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 398 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVHSVAPQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 399 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatactcagtcgaggattacaggggtgctgtcgaagctctgcagatcaggccatttgctctagtgaatgctgtggctccacaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagtatgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 400 - protein, 254 aa, Artificial
  Synthetic Construct
MSTAIVTNVKHFGGMGSALKLSEAGHTVACHDESFKHKDELEAFAEAYPQLKPMSEQEPAELIEAVTSAFGHVDVLVSNDIFALEFRPIDKYSVEDYRGAVEALQIRPFALVNAVAPQMKKRKSGHIIFITSAAPFGPWKELSTYSSARAGTSALANALSKELGEYNIPVFAIGPNYLHSEDSPFYYPTEPWKINPEYVAHVKKVTALQRLGTQKELGELVAFLASGSCDYLTGQVFWLAGGFPVIERWPGMPE

SEQ ID NO: 401 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatggtagctttaagcataaagatgaactggaagcttttgctgaaacctacccacagctgaaaccaatgagcgaacaggaaccagctgaactgattgaagctgtcaccagcgcttttggtcatgtcgatgtcctggtcagcaacgatatctttgctctagaatttcggccaatcgataaatactcagtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 402 - protein, 254 aa, Artificial
  Synthetic Construct
MSTAIVTNVKHFGGMGSALKLSEAGHTVACHDGSFKHKDELEAFAETYPQLKPMSEQEPAELIEAVTSAFGHVDVLVSNDIFALEFRPIDKYSVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPAIERWPGMLE

SEQ ID NO: 403 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgagaactacaggggtgctgtcgaagctctgcagatcaggccatttgctctagtgcattcggtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgccatagaacgttggcccggcatgctggaataatga

SEQ ID NO: 404 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVENYRGAVEALQIRPFALVHSVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPAIERWPGMLE

SEQ ID NO: 405 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaagccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 406 - protein, 254 aa, Artificial
  Synthetic Construct
MSTAIVTNVKHFGGMGSALRLSEAGHTVACHDESFKHKDELEAFAEAYPQLKPMSEQEPAELIEAVTSAFGQVDVLVSNDIFALEFRPIDKYAVEDYRGAVEALQIKPFALVNAVASQMKKRKSGHIIFITSAAPFGPWKELSTYSSARAGTSALANALSKELGEYNIPVFAIGPNYLHSEDSPFYYPTEPWKINPEHVAHVKKVTALQRLGTQKELGELVAFLASGSCDYLTGQVFWLAGGFPVIERWPGMPE

SEQ ID NO: 407 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattagtccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 408 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKISPEHVAHVKKVTALQRLGTQKELGELVAFLASGSCDYLTGQVFWLAGGFPVIERWPGMLE

SEQ ID NO: 409 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatggccgaacaggaaccagctgaactgattgaagctgtcaccagcgcttttggtcatgtcgatgtcctggtcagcaacgatatctttgctctagaatttcggccaatcgataaatactcagtcgagaactacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgctatagaacgttggcccggcatgctggaataatga

SEQ ID NO: 410 - protein, 254 aa, Artificial
  Synthetic Construct
MSTAIVTNVKHFGGMGSALKLSEAGHTVACHDESFKHKDELEAFAEAYPQLKPMAEQEPAELIEAVTSAFGHVDVLVSNDIFALEFRPIDKYSVENYRGAVEALQIRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVAFLASGSCDYLTGQVFWLAGGFPAIERWPGMLE

SEQ ID NO: 411 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatggtagctttaagcataaagatgaactggaagcttttgctgaagcctacccacagctgaaaccactgagcgaacaggaaccagctgaactgattgaagctgtcaccagcgcttttggtcaggtcgatgtcctggtcagcaacgatatctttgctctagaatttcggccaatcgataaatactcagtcgagaactacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctagctaaggagctaggagagtacaatatcccggtgttcgctatcgggccgaattacctacactcggaggattcgccgtactattaccccactgagccgtggaagattaatccggagtatgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 412 - protein, 254 aa, Artificial
  Synthetic Construct
MSTAIVTNVKHFGGMGSALRLSEAGHTVACHDGSFKHKDELEAFAEAYPQLKPLSEQEPAELIEAVTSAFGQVDVLVSNDIFALEFRPIDKYSVENYRGAVEALQIRPFALVNAVASQMKKRKSGHIIFITSAAPFGPWKELSTYSSARAGTSALANALAKELGEYNIPVFAIGPNYLHSEDSPYYYPTEPWKINPEYVAHVKKVTALQRLGTQKELGELVAFLASGSCDYLTGQVFWLAGGFPVIERWPGMPE

SEQ ID NO: 413 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgtcatgacgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatactcagtcgagaactacaggggtgctgtcgaagctctgcagatcaggccatttgctctagtgaatgctgtggctccacaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 414 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYSVENYRGAVEALQIRPFALVNAVAPQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 415 - DNA, 768 bp, Artificial
  HHDH
  CDS (1)..(768)
atgagcaccgctattgtcaccaacgtcaaacattttggaggtatgggtagcgctctgaaactgagcgaagctggtcataccgtcgcttgccatgatgaaagctttaagcataaagatgaactggaagcttttgctgaagcctacccacagctgaaaccaatgagcgaacaggaaccagctgaactgattgaagctgtcaccagcgcttttggtcatgtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgttctattaccccactgagccgtggaagattaatccggagcacgtggctcacgtgaagaaggtgactgctctacgtcgactagggactcaaaaagagttgggggaattggtggcatttttggcatctggctcttgtgattatttgactggccaggtgttttggttggcaggcggctttcccgctatagaacgttggcccggcatgcccgaataatga

SEQ ID NO: 416 - protein, 254 aa, Artificial
  Synthetic Construct
MSTAIVTNVKHFGGMGSALKLSEAGHTVACHDESFKHKDELEAFAEAYPQLKPMSEQEPAELIEAVTSAFGHVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPFYYPTEPWKINPEHVAHVKKVTALRRLGTQKELGELVAFLASGSCDYLTGQVFWLAGGFPAIERWPGMPE

SEQ ID NO: 417 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaattcggtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgctggaataatga

SEQ ID NO: 418 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNSVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMLE

SEQ ID NO: 419 - DNA, 768 bp, Artificial
  HHDH
  CDS (1)..(768)
atgagcaccgctattgtcaccaacgtcaaacattttggaggtatgggtagcgctctgaggctgagcgaagctggtcataccgtcgcttgccatgatggtagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 420 - protein, 254 aa, Artificial
  Synthetic Construct
MSTAIVTNVKHFGGMGSALRLSEAGHTVACHDGSFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 421 - DNA, 774 bp, Artificial
  CDS (1)..(774)
atgagcagcgctatcgtcactaacgtcaaacattttggtggtatgggtagcgctctgaggctgagcgaagctggtcataccgtcgcttgccatgatggaagctttaaacagaaagatgaactggaagattttgcagacacctacccacagatgaaaccaatgagcgaacaggaaccaggtgaactgatcgaagctgtcaccagcgcttacggtcaggtcgatgtcctggtcagcaacgatgtctttgctccagaatttcagccaatggataaatacgctgtcgaagattacaggggtgctgtcgaagctccgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacctgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 422 - protein, 254 aa, Artificial
  Synthetic Construct
MSSAIVTNVKHFGGMGSALRLSEAGHTVACHDGSFKQKDELEDFADTYPQMKPMSEQEPGELIEAVTSAYGQVDVLVSNDVFAPEFQPMDKYAVEDYRGAVEAPQIRPFALVNAVASQMKKRKSGHIIFITSATPFGPWKELSTYTSARAGACTLANALSKELGEYNIPVFAIGPNYLHSEDSPYFYPTEPWKTNPEHVAHLKKVTALQRLGTQKELGELVAFLASGSCDYLTGQVFWLAGGFPMIERWPGMPE

SEQ ID NO: 423 - DNA, 774 bp, Artificial
  Comment
  CDS (1)..(774)
atgagcagcgctattgtcaccaacttcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcatatcaagccatttgctctagtgaatgctgccgcttcccaaatgaacaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 424 - protein, 254 aa, Artificial
  Synthetic Construct
MSSAIVTNFKHFGGMGSALRLSEAGHTVACHDESFKHQDELEAFAETYPQLIPMSEQEPAELIEAVTSALGHVDVLVSNDIAPVEWRPIDKYAVEDYRDTVEALHIKPFALVNAAASQMNKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 425 - DNA, 774 bp, Artificial
  Comment
  CDS (1)..(774)
atgagcaccgctatcgtcaccaacttcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcatcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctaccccgttcgggccatggaaggagctatcgacttacacttcggctcgagctggggcttgtcccctagctaatgctctatcgaaggagctaggagagtacaatatcccggtgttcgctatcgggcctaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactgaccaggtgttttggttggcaggcggctttcccatgatagaacgttggcccggcatgcccgaataatgaggatcc

SEQ ID NO: 426 - protein, 254 aa, Artificial; identical to SEQ ID NO: 144
  Synthetic Construct

SEQ ID NO: 427 - DNA, 768 bp, Artificial
  Comment
  CDS (1)..(768)
atgagcaccgctattgtcaccaacttcaaacattttggaggtatgggtagcgctctgcgtctgagcgaagctggtcataccgtcgcttgccatgatgaaagctttaagcatcaggatgaactgaaagcttttgctaaaacctacccacagctgataccaatgagcgaacagcaaccagctcaactgattaaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaggcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 428 - protein, 254 aa, Artificial
  Synthetic Construct
MSTAIVTNFKHFGGMGSALRLSEAGHTVACHDESFKHQDELKAFAKTYPQLIPMSEQQPAQLIKAVTSALGQVDVLVSNDIAAVEWRPIDKYAVEDYRGTVEALQIKPFALVNAVASQMKRRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFLASGSCDYLTGQVFWLAGGFPVIERWPGMPE

SEQ ID NO: 429 - DNA, 768 bp, Artificial
  Comment
  CDS (1)..(768)
atgagcaccgctattgtcacgaacttcacacattttggaggtatgggtagcgctctcaggctgagcgaagctggtcataccgtcgcttgccatgatgaaagctttaagcatcaggatgaactggaagcttttgctgacacctacccacagctgataccaatgagcgaacaggaaccagctgaactgattgaagctgtcaccagcgcttttggtcaggtcgatgtcctggtcagcaacgatatcgctgctgtggaatggcggccaatcgataaatacgctgtcgaggattacaggggtactgtcgaagctctgcagatccgcccatttgctctagtgaatgctgtggcttcgcaaatgaagaagcgacgttcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagatttctccggagcacgtggctcacgtgcgtaaggtgactgctctacgtcgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 430 - protein, 254 aa, Artificial
  Synthetic Construct
MSTAIVTNFTHFGGMGSALRLSEAGHTVACHDESFKHQDELEAFADTYPQLIPMSEQEPAELIEAVTSAFGQVDVLVSNDIAAVEWRPIDKYAVEDYRGTVEALQIRPFALVNAVASQMKKRRSGHIIFITSAAPFGPWKELSTYSSARAGASALANALSKELGEYNIPVFAIAPNYLHSEDSPYYYPSEPWKISPEHVAHVRKVTALRRLGTQKELGELVTFLASGSCDYLTGQVFWLAGGFPVIERWPGMPE

SEQ ID NO: 431 - DNA, 768 bp, Artificial
  Comment
  CDS (1)..(768)
atgagcaccgttattgtcaccaacttcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcacttttggtcaggtcgatgtcctggtcagcaacgatatctttgctgtggaatggcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgctccgaattacctacactcggaggattcgccgtactattacccctctgagccgtggaagatttctccggagcacgtggctcacgtgcgtaaggtgactgctctacgtcgactagggactcaacgcgagttgggggaattggtgacatttttggcatctggctcttgtgattatttgactggccaggtgttttggttggcaggcggctttcccgtcatcgaacgttggcccggcatgcccgaataatga

SEQ ID NO: 432 - protein, 254 aa, Artificial
  Synthetic Construct
MSTVIVTNFKHFGGMGSALRLSEAGHTVACHDESFKHKDELEAFAETYPQLKPMSEQEPAELIEAVTSTFGQVDVLVSNDIFAVEWRPIDKYAVEDYRGAVEALQIRPFALVNAVASQMKKRKSGHIIFITSAAPFGPWKELSTYSSARAGTSALANALSKELGEYNIPVFAIAPNYLHSEDSPYYYPSEPWKISPEHVAHVRKVTALRRLGTQRELGELVTFLASGSCDYLTGQVFWLAGGFPVIERWPGMPE

SEQ ID NO: 433 - DNA, 711 bp, Artificial
  Comment
  CDS (1)..(711)
atggccaacggtcgcaaacgcgagttcgcgaacggccgcctggcgggcaaactcgtgctgctgaccaacgccgatgcctacatgggtgaagcgaccgtgcaggttttcgaggaagagggcgcggaagtttttgccgaccacaccgacctgaccaaagtgggcgccgccgaagaagtggtggaacgcgcgggccacatcgatgtgctggttgccaactttgcggtggatgcgcactttggtgttaccgtgctggaaaccgatgaagagctgtggcagaccgcctatgagaccatcgttcatccgctgcaccgtatctgtcgcgccgtgctgccgcagttttatgaacgcaacaaaggcaaaatcgtggtgtacggtagcgccgccgccatgcgttatcaagaaggtgcgctggcctacagcaccgcccgcttcgcgcagcgtggttacgtgaccgccctgggccctgaggccgcgcgtcacaacgtgaacgtgaacttcattgcccagcattggacccagaataaagaatacttctggccggaacgcatcgcgaccgacgaattcaaagaagatatggcgcgccgcgttccgctgggtcgcctggccaccgcgcgcgaagacgcgctgctggccctgtttctggcgagcgacgaaagcgattttatcgttggtaaaagcattgagtttgatggcggttgggcgacctaatga

SEQ ID NO: 434 - protein, 235 aa, Artificial
  Synthetic Construct
MANGRKREFANGRLAGKLVLLTNADAYMGEATVQVFEEEGAEVFADHTDLTKVGAAEEVVERAGHIDVLVANFAVDAHFGVTVLETDEELWQTAYETIVHPLHRICRAVLPQFYERNKGKIVVYGSAAAMRYQEGALAYSTARFAQRGYVTALGPEAARHNVNVNFIAQHWTQNKEYFWPERIATDEFKEDMARRVPLGRLATAREDALLALFLASDESDFIVGKSIEFDGGWAT

SEQ ID NO: 435 - DNA, 768 bp, Artificial
  Comment
  CDS (1)..(768)
atgagcaccgctattgtcaccaacgtcctccattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcgtctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 436 - protein, 254 aa, Artificial
  Synthetic Construct
MSTAIVTNVLHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSSRAGTSALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 437 - DNA, 774 bp, Artificial
  Comment
  CDS (1)..(774)
atgagcaccgctattgtcaccaacgtcaaacattttggaggtatgggtagcgctctgtgtctgagcgaagctggtcataccgtcgcttgccatgatgaaagctttaagcatcaggatgaactagaagcttttgctgaaacctacccacagctgataccaatgagcgaacagaaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 438 - protein, 254 aa, Artificial
  Synthetic Construct
MSTAIVTNVKHFGGMGSALCLSEAGHTVACHDESFKHQDELEAFAETYPQLIPMSEQKPAELIEAVTSALGHVDVLVSNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 439 - DNA, 768 bp, Artificial
  Comment
  CDS (1)..(768)
atgagcaccgctatcgtcaccaacgtcaaacattttggtggtatgggtagcgttctgaggctgagcgaagctggtcataccgtcgcttgccttgttgaaagctttaaacagaaagatgaactggaagcttttgctgaaacctacccacagctgaactcaatgagcgaacaggaaccagctgaactgatcgaagctgtcaccagcgcttacggtcaggtcgatgtcctggtcagcaacgatatctttgctccaggatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagataatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggatggcaggcggctttcccatgatagaacgttggcccggcatgcccgaataatga

SEQ ID NO: 440 - protein, 254 aa, Artificial
  Synthetic Construct
MSTAIVTNVKHFGGMGSVLRLSEAGHTVACLVESFKQKDELEAFAETYPQLNSMSEQEPAELIEAVTSAYGQVDVLVSNDIFAPGFQPIDKYAVEDYRGAVEALQIRPFALVNAVASQMKKRKSGHIIFITSATPFGPWKELSTYTSARAGACTLDNALSKELGEYNIPVFAIGPNYLHSEDSPYFYPTEPWKTNPEHVAHVKKVTALQRLGTQKELGELVAFLASGSCDYLTGQVFWMAGGFPMIERWPGMPE

SEQ ID NO: 441 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccttgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccacgtaaggaggtctcgacttactcttcggctcgagctggggctagtgcactagctaatgctctatcgaaggagctaggagagtacaatatcccggtgttcgctatcgctccgcgttacctacacatcggggattcgccgtacaaatacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 442 - protein, 254 aa, Artificial
  Synthetic Construct
MSTAIVTNVKHFGGMGSALRLSEAGHTVACLDESFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAAPFGPRKEVSTYSSARAGASALANALSKELGEYNIPVFAIAPRYLHIGDSPYKYPSEPWKTSPEHVAHVRKVTALQRLGTQKELGELVTFLASGSCDYLTGQVFWLAGGFPVIERWPGMPE

SEQ ID NO: 443 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatggaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcggcgtactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 444 - protein, 254 aa, Artificial
  Synthetic Construct
MSTAIVTNVKHFGGMGSALRLSEAGHTVACHDGSFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSAYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 445 - DNA, 774 bp, Artificial
  CDS (1)..(774)
atgagcaccgctattgtcaccaacgtcaaacattttggaggtatgggtagcgctctgaggctgagcgaaggtggtcataccgtcgcttgccatgatggaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcagccaatcgataaatacgctgtcgaagattacaggggtgctgtcgaagctctgcagatcaggccacttgctctagtgaatgctgtggctccgcaaatgaagaagcgaaagtcggggcacatcatcttcatcacttcggctgccccgttcgggccatggaaggagctatcgacttacacttcggctcgagctggggctagtactctagttaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataatgaggatcc

SEQ ID NO: 446 - protein, 254 aa, Artificial
  Synthetic Construct
MSTAIVTNVKHFGGMGSALRLSEGGHTVACHDGSFKQKDELEAFAETYPQLKPMSEQEPAELIEAVTSAFGQVDVLVSNDIFALEFQPIDKYAVEDYRGAVEALQIRPLALVNAVAPQMKKRKSGHIIFITSAAPFGPWKELSTYTSARAGASTLVNALSKELGEYNIPVFAIGPNYLHSEDSPYYYPTEPWKINPEHVAHVKKVTALQRLGTQKELGELVAFLASGSCDYLTGQVFWLAGGFPTIERWPGMPE

SEQ ID NO: 447 - DNA, 768 bp, Artificial
  CDS (1)..(768)
atgagcgccgctatcgtcaccagcgtcaaccattttggtggtatgggtagcgctctgaggctgaacgaagctggtcataccttcgcttgccatgatggaagctttaaccagaaagatgaactggaagcttttactgaagcctacgcacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgtttaagttggcaggcggctttcccatgatagaacgttggcccggcatgcccgaataatga

SEQ ID NO: 448 - protein, 254 aa, Artificial
  Synthetic Construct
MSAAIVTSVNHFGGMGSALRLNEAGHTFACHDGSFNQKDELEAFTEAYAQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFKLAGGFPMIERWPGMPE

SEQ ID NO: 449 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaactgcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactggtctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 450 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPELQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTGLQRLGTQKELGELVAFLASGSCDYLTGQVFWLAGGFPMIERWPGMPE

SEQ ID NO: 451 - DNA, 774 bp, Artificial
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtccaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 452 - protein, 254 aa, Artificial; identical to SEQ ID NO: 136
  Synthetic Construct

SEQ ID NO: 453 - DNA, 774 bp, Artificial
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaagtcgaagcttttgctgaaacctacccacagctgaaaccaatgagcgaacaggaaccagctgaactgatcgaagctgtcaccagcgcttacggtcaggtcgatgtcctggtcagcaacgatatctttgctccagaactgcatccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcgtctactccgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccagctgttttggttggcaggcggctttcccatgatagaacgttggcccggcatgcccgaataatgaggatcc

SEQ ID NO: 454 - protein, 254 aa, Artificial
  Synthetic Construct
MSTAIVTNVKHFGGMGSALRLSEAGHTVACHDESFKQKDEVEAFAETYPQLKPMSEQEPAELIEAVTSAYGQVDVLVSNDIFAPELHPIDKYAVEDYRGAVEALQIRPFALVNAVASQMKKRKSGHIIFITSSTPLGPWKELSTYTSARAGACTLANALSKELGEYNIPVFAIGPNYLHSEDSPYFYPTEPWKTNPEHVAHVKKVTALQRLGTQKELGELVAFLASGSCDYLTGQLFWLAGGFPMIERWPGMPE

SEQ ID NO: 455 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgatctggaagcttttgctgatacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgcggcttcgcaaatgaagaagcgaaagtcggggcacatcatcttcatcacttcggctactccgttcgggccatggaaggagctatcgacttacacttcggctcgagccggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 456 - protein, 254 aa, Artificial
  Synthetic Construct
MSTAIVTNVKHFGGMGSALRLSEAGHTVACHDESFKQKDDLEAFADTYPQLKPMSEQEPAELIEAVTSAYGQVDVLVSNDIFAPEFQPIDKYAVEDYRGAVEALQIRPFALVNAAASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 457 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactggggactcaaaaagagttgggggaattggtggcatttttggcatctggctcttgtgattatttgactggccaggtgttttggatggcaggcggctttcccatgatagaacgttggcccggcatgcccgaataatgaggatcc

SEQ ID NO: 458 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWMAGGFPMIERWPGMPE

SEQ ID NO: 459 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccagtgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcggcgtactcttcggctcgagctggggctagtgcactagctaatgctctatcgaaggagctaggagagtacaatatcccggtgttcgctatcgggccgaattacctacactcgaaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 460 - protein, 254 aa, Artificial
  Synthetic Construct
MSTAIVTNVKHFGGMGSALRLSEAGHTVACHDESFKHKDELEAFAETYPQLKPVSEQEPAELIEAVTSAFGQVDVLVSNDIFALEFRPIDKYAVEDYRGAVEALQIRPFALVNAVASQMKKRKSGHIIFITSAAPFGPWKELSAYSSARAGASALANALSKELGEYNIPVFAIGPNYLHSKDSPYYYPTEPWKINPEHVAHVKKVTALQRLGTQKELGELVAFLASGSCDYLTGQVFWLAGGFPVIERWPGMPE

SEQ ID NO: 461 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccagtgagcgaacaggaaccagctgaactgattgaagcagtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatga

SEQ ID NO: 462 - protein, 254 aa, Artificial
  Synthetic Construct
MSTAIVTNVKHFGGMGSALRLSEAGHTVACHDESFKHQDELEAFAETYPQLIPVSEQEPAELIEAVTSALGHVDVLVSNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 463 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccagtgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 464 - protein, 254 aa, Artificial; identical to SEQ ID NO: 462
  Synthetic Construct

SEQ ID NO: 465 - DNA, 774 bp, Artificial
  CDS (1)..(774)
atgagcaccgctattgtcaccaacgtcaaacattttgggggtatgggtagcgctctgcgtctgagcgaagctggtcataccgtcgcttgccatgatgaaagctttaagcatcaggatgaactagaagcttttgctgaaacctacccacagctgataccagtgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggaccc

SEQ ID NO: 466 - protein, 254 aa, Artificial
  Synthetic Construct
MSTAIVTNVKHFGGMGSALRLSEAGHTVACHDESFKHQDELEAFAETYPQLIPVSEQEPAELIEAVTSALGHVDVLVSNDIAPVEWRPIDKYAVEDYRDTVEALQIKPFALVNAVASQMKKRKSGHIIFITSAAPFGPWKELSTYSSARAGTSALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 467 - DNA, 768 bp, Artificial
  CDS (1)..(768)
atgagcgccgctattgtcaccaacgtcaaacattttggaggtatgggtagcgctctgcgtctgagcgaagctggttataccgtcgcttgccatgatgaaagctttaagcatcaggatgaactggaagcttttgctgaaacctacccacagctgataccagtgagcgaacaggaaccaactgaactgattgaagctgtcaccggtgctcttggtcaggtcgatgtcctggtcagcaacgatatctatcctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaacgcgagttgggggaattggtggcatttttggcatctggctcttgtgattatttgactggccaggtgttttggttggcaggcggctttcccgtcatcgaacgttggcccggcatgcccgaataatga

SEQ ID NO: 468 - protein, 254 aa, Artificial
  Synthetic Construct
MSAAIVTNVKHFGGMGSALRLSEAGYTVACHDESFKHQDELEAFAETYPQLIPVSEQEPTELIEAVTGALGQVDVLVSNDIYPVEWRPIDKYAVEDYRGTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQRELGELVAFLASGSCDYLTGQVFWLAGGFPVIERWPGMPE

SEQ ID NO: 469 - DNA, 774 bp, Artificial
  Comment
  CDS (1)..(774)
atgggccccgttatggtcactaacgtcaaacattttggtggtaagggtagcgctctgaggctgagcgaagctggtcataccgtcgcttgccatgatgaaagctttaaacagaaagatgaactggaagcttttgctgaaacctacccacagctgaaaccagtgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaagtgactgctctacaacgactagggactcaaaaagagttgggggaattggtggcatttttggcatctggctcttgtgattatttgacgggccaggtgttttggttggcaggcggcttctccaagaaaaaaagttggcccggcttgcccgaataatgaggatcc

SEQ ID NO: 470 - protein, 254 aa, Artificial
  Synthetic Construct
MGPVMVTNVKHFGGKGSALRLSEAGHTVACHDESFKQKDELEAFAETYPQLKPVSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFSKKKSWPGLPE

SEQ ID NO: 471 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgcgtccgatgcgtgatcaggaaccaccggacctgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 472 - protein, 254 aa, Artificial
  Synthetic Construct
MSTAIVTNVKHFGGMGSALRLSEAGHTVACHDESFKQKDELEAFAETYPQLRPMRDQEPPDLIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 473 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgatcaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcggaccatggaaggagctatcgacttactcttcggctcgagctggggctagtgcactagctaatgctctatcgaaggagctaggagagtacaatatcccggtgttcgctatcgctccgaattacctacattcgggggattcgccgtactattacccctctgagccgtggaagacttctcctgagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcctgaataatgaggatcc

SEQ ID NO: 474 - protein, 254 aa, Artificial
  Synthetic Construct
MSTAIVTNVKHFGGMGSALRLSEAGHTVACHDESFKHQDELEAFAETYPQLIPMSDQEPAELIEAVTSALGHVDVLVSNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 475 - DNA, 768 bp, Artificial
  Comment
  CDS (1)..(768)
atgagcgccggtatcgtcaccatcgtcaaacattttggtggtatgggaagccctctgaggctgatcgaagctggtcataccgtcgcttgccatgaggaaagctttaatcagaaagatgatctggaagcttttggtgatacctgcccacagctgaaaccaatgagggatcagggaccagctgatctgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 476 - protein, 254 aa, Artificial
  Synthetic Construct
MSAGIVTIVKHFGGMGSPLRLIEAGHTVACHEESFNQKDDLEAFGDTCPQLKPMRDQGPADLIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 477 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggataaactggaagcttttgctgaaacctacccacagctgataccaatgagcaaacagaaaccagctaaactgattgaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccagtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacattttcggcatctggctcttgtgattatttgactggccaggtgttttggttggcaggcggctttcccgtcatcgaacgttggcccggcatgcccgaataatga

SEQ ID NO: 478 - protein, 254 aa, Artificial
  Synthetic Construct
MSTAIVTNVKHFGGMGSALRLSEAGHTVACHDESFKHQDKLEAFAETYPQLIPMSKQKPAKLIEAVTSALGQVDVLVSNDIAAVEWRPIDKYAVEDYRGTVEALQIKPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFSASGSCDYLTGQVFWLAGGFPVIERWPGMPE

SEQ ID NO: 479 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggataaactggaagcttttgctgaaacctacccacagctgataccaatgagcaaacagaaaccagctgaactgattgaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 480 - protein, 254 aa, Artificial
  Synthetic Construct
MSTAIVTNVKHFGGMGSALRLSEAGHTVACHDESFKHQDKLEAFAETYPQLIPMSKQKPAELIEAVTSALGQVDVLVSNDIAAVEWRPIDKYAVEDYRGTVEALQIKPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFLASGSCDYLTGQVFWLAGGFPVIERWPGMPE

SEQ ID NO: 481 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactgaaagcttttgctaaaacctacccacagctgataccaatgagccaacagaaaccagctaaactgattcaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 482 - protein, 254 aa, Artificial
  Synthetic Construct
MSTAIVTNVKHFGGMGSALRLSEAGHTVACHDESFKHQDELKAFAKTYPQLIPMSQQKPAKLIQAVTSALGQVDVLVSNDIAAVEWRPIDKYAVEDYRGTVEALQIKPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFLASGSCDYLTGQVFWLAGGFPVIERWPGMPE

SEQ ID NO: 483 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgataccaatgagccaacagaaaccagctgaactgattgaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggcgttttggttggcaggcggctttcccgtcatcgaacgttggcccggcatgcccgaataatga

SEQ ID NO: 484 - protein, 254 aa, Artificial
  Synthetic Construct
MSTAIVTNVKHFGGMGSALRLSEAGHTVACHDESFKHQDELEAFAETYPQLIPMSQQKPAELIEAVTSALGQVDVLVSNDIAAVEWRPIDKYAVEDYRGTVEALQIKPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFLASGSCDYLTGQAFWLAGGFPVIERWPGMPE

SEQ ID NO: 485 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgataccaatgagcgaacagaaaccagctaaactgattaaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 486 - protein, 254 aa, Artificial
  Synthetic Construct
MSTAIVTNVKHFGGMGSALRLSEAGHTVACHDESFKHQDELEAFAETYPQLIPMSEQKPAKLIKAVTSALGQVDVLVSNDIAAVEWRPIDKYAVEDYRGTVEALQIKPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFLASGSCDYLTGQVFWLAGGFPVIERWPGMPE

SEQ ID NO: 487 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagttttaagcatcaggatgaactggaagcttttgctgaaacctacccacagctgatgccaatgagcgaacagaaaccagctcaactgattcaagctgtcaccagcgctcttggtcaggtcgatgtcctggtcagcaacgatatcgctgctgtggaatggcggccaatcgataaatacgctgtcgaggattacaggggtactgacgaagctctgcagttcaagccatttgctctagtgaatgctgtcgcttcgcaaatgaagaagcgaaagtcggggcacatcatcttcatcacttcggctgccccgttcgggccatggaaggagctatcgactcactcttcggctcgagctggggctagtgcactagctaatgctctatcgaaggagctaggagagtacaatatcccggtgttcgctatcgctccgaattacctatactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 488 - protein, 254 aa, Artificial
  Synthetic Construct
MSTAIVTNVKHFGGMGSALRLSEAGHTVACHDESFKHQDELEAFAETYPQLMPMSEQKPAQLIQAVTSALGQVDVLVSNDIAAVEWRPIDKYAVEDYRGTDEALQFKPFALVNAVASQMKKRKSGHIIFITSAAPFGPWKELSTHSSARAGASALANALSKELGEYNIPVFAIAPNYLYSEDSPYYYPSEPWKTSPEHVAHVRKVTALQRLGTQKELGELVTFLASGSCDYLTGQVFWLAGGFPVIERWPGMPE

SEQ ID NO: 489 - DNA, 768 bp, Artificial
  Comment
  CDS (1)..(768)
atgagcaccgctatcgtcaccaacgtcaaacattttggaggtatgggtagcgctctgaggctgagcgaagctggtcacaccgtcgcttgccatgatgaaagctttaaacagaaagatgaactggaggcttttgctgaaacctacccacagctgaaaccaatgagcgaacaggaaccagctgaactggttgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcctggcatgcccgaataatga

SEQ ID NO: 490 - protein, 254 aa, Artificial
  Synthetic Construct
MSTAIVTNVKHFGGMGSALRLSEAGHTVACHDESFKQKDELEAFAETYPQLKPMSEQEPAELVEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 491 - DNA, 768 bp, Artificial
  Comment
  CDS (1)..(768)
atgagcaccgctatcgtcaccaacgtcaaacattttggaggtatgggtagcgctctgaggctgtcgcaggctggtcacaccgtcgcttgccatgatgaaagctttaaacagaaagatgaactggaggcttttgctgaaacctacccacagctgaaaccaatgagcgaacaggaaccagctgaactggttgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 492 - protein, 254 aa, Artificial
  Synthetic Construct
MSTAIVTNVKHFGGMGSALRLSQAGHTVACHDESFKQKDELEAFAETYPQLKPMSEQEPAELVEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 493 - DNA, 774 bp, Artificial
  Comment
  CDS (1)..(774)
atgagcaccgctatcgtcaccaacgtcaaacattttggaggtatgggtagcgctctgaggctgtcggaggctggtcacaccgtcgcttgccatgatgaaagctttaaacagaaagatgaactggaagcttttgctgaaacctacccacagctgaaaccaatgagcgaacaggaaccagctgaactggttgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggctccgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 494 - protein, 254 aa, Artificial
  Synthetic Construct
MSTAIVTNVKHFGGMGSALRLSEAGHTVACHDESFKQKDELEAFAETYPQLKPMSEQEPAELVEAVTSAYGQVDVLVSNDIFAPEFQPIDKYAVEDYRGAVEALQIRPFALVNAVAPQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 495 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgagcaggaaccagctgaactggttgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatga

SEQ ID NO: 496 - protein, 254 aa, Artificial
  Synthetic Construct
MSTAIVTNVKHFGGMGSALRLSEAGHTVACHDESFKHQDELEAFAETYPQLIPMSEQEPAELVEAVTSALGHVDVLVSNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 497 - DNA, 774 bp, Artificial
  Comment
  CDS (1)..(774)
atgagcacctctattgtcaccaacgtcaaacattttggaggtatgggtagcgctctgcgtctgagcgaagctggtcataccgtcgcttgccatgatgaaagctttaggcatcaggatgaactagaagcttttgctgaaacctacccacagctgataccaatgagcgaacaggaaccagctgaactggttgaagctgtcaccagcgctcttggtcatgtcgatgtcctggtcagcaacgagatcgcgcctgtggaatggcggccaatcgatagatacgctgtcgaggattacagggatactgtcgaagctctgcagatcaagccatttgctctagtgaatgctgtcgcttcgcaaatgaagaagcgaaagtcggggcacatcatcttcatcacttcggctgccccattcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 498 - protein, 254 aa, Artificial
  Synthetic Construct
MSTSIVTNVKHFGGMGSALRLSEAGHTVACHDESFRHQDELEAFAETYPQLIPMSEQEPAELVEAVTSALGHVDVLVSNEIAPVEWRPIDRYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 499 - DNA, 774 bp, Artificial
  Comment
  CDS (1)..(774)
atgagcaccgctaccgtcaccaacgtcaaacattttggaggtatgggtagcgctctgaagctgagcgaagctggtcataccgtcgcttgccatgatgaaagctttaaacagaaagatgaactggaagcttttgctgaagcctacccacagctgaaaccaatgagcgaacaggatccagctgacctgattgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctggctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgattagggactcaaaaagagttgggggaattggtggcattcctggcatctggctcttgtgattatttgactggccaggtgttttggttggcaggcggctttcccctaatagaacgttggcccggcatgcccgaataatgaggatcc

SEQ ID NO: 500 - protein, 254 aa, Artificial
  Synthetic Construct
MSTATVTNVKHFGGMGSALKLSEAGHTVACHDESFKQKDELEAFAEAYPQLKPMSEQDPADLIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPLIERWPGMPE

SEQ ID NO: 501 - DNA, 765 bp, Artificial
  Comment
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaagcgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccattatcgaacgttggcccggcatgcccgaataa

SEQ ID NO: 502 - protein, 254 aa, Artificial; identical to SEQ ID NO: 56
  Synthetic Construct

SEQ ID NO: 503 - DNA, 696 bp, Artificial
  Comment
  CDS (1)..(696)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgccctacaacgactagggactcaaaaagagttgggggaattggtggcatttttggcatctggctcttgtgattttctg

SEQ ID NO: 504 - protein, 232 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDFL

SEQ ID NO: 505 - DNA, 765 bp, Artificial
  Comment
  CDS (1)..(765)
atgagcaccgctatcgtcaccaacgtcaaacattttggaggtatgggtagcgctctgaggctgagcgaagctggtctgaccgtcgcttgccatgatgaaagctttaaacagaaagatgaactggaagcttttgctggaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaaacgaaagtcggggcacatcatcttcatcacttcgtctactccgttcgggccatggaaagagctatcgacttacacttcggctcgagctggggcttgtgctctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcctctaatagaacgttggcccggcatgcccgaataa

SEQ ID NO: 506 - protein, 254 aa, Artificial
  Synthetic Construct
MSTAIVTNVKHFGGMGSALRLSEAGLTVACHDESFKQKDELEAFAGTYPQLKPMSEQEPAELIEAVTSAYGQVDVLVSNDIFAPEFQPIDKYAVEDYRGAVEALQIRPFALVNAVASQMKKRKSGHIIFITSSTPFGPWKELSTYTSARAGACALANALSKELGEYNIPVFAIGPNYLHSEDSPYFYPTEPWKTNPEHVAHVKKVTALQRLGTQKELGELVAFLASGSCDYLTGQVFWLAGGFPLIERWPGMPE

SEQ ID NO: 507 - DNA, 774 bp, Artificial
  Comment
  CDS (1)..(774)
atgagcaccgttatcgtcaccaacgtcaaacattttggaggtatggccagcgctctgaggctgagcgaagctggtcaaaccgtcgcttgccatgatgaaagctttaaacagaaagatgaactggaagcttttggtgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcctcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 508 - protein, 254 aa, Artificial
  Synthetic Construct
MSTVIVTNVKHFGGMASALRLSEAGQTVACHDESFKQKDELEAFGETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 509 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcgtgtcgatgtcctggtcagcaacgatatcgcgcctgtggaatggcggccaatcgataaatacgctgtcgaggattacagggatactgtcgaagctctgcagatcaagccatttgctctagtgaatgctgtcgctccgcaaatgaagaagcgaaagtcggggcacatcatcttcatcacttcggctgcaccgttcgggccatggaaggagctctcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 510 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGRVDVLVSNDIAPVEWRPIDKYAVEDYRDTVEALQIKPFALVNAVAPQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 511 - DNA, 774 bp, Artificial
  Comment
  CDS (1)..(774)
atgaccaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatatcctggtcagcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctgctccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 512 - protein, 254 aa, Artificial; identical to SEQ ID NO: 80
  Synthetic Construct

SEQ ID NO: 513 - DNA, 774 bp, Artificial
  Comment
  CDS (1)..(774)
atgaccaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgacctgatcgaagctgtcaccagcgcttacggtcaggtcgatatcctggtcagcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctgctccgttcgggccatggaaggagctatcgacttacacttcggctcgagctggggcttgttccctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccatgatagaacgttggcccggcatgcccgaataatgaggatcc

SEQ ID NO: 514 - protein, 254 aa, Artificial
  Synthetic Construct
MTTAIVTNVKHFGGMGSALRLSEAGHTVACHDESFKQKDELEAFAETYPQLKPMSEQEPADLIEAVTSAYGQVDILVSNDIFAPEFQPIDKYAVQDYRGAVEALQIRPFALVNAVASQMKKRKSGHIIFITSAAPFGPWKELSTYTSARAGACSLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 515 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacacaaagatgatctggaagcttttgctgaaacctacccacagctgaaaccaatgagcgaacaggaaccagctgaactgatcgaagctgtcaccagcgcttacggtcaggtcgatatcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcgtctactccgttcgggccatggaaagagctatcgacttacacttcggctcgagctggggcttgtactctagctaatgctctatcgaaggagctaggagagtacaatgtgccggtgttcgctatcgggccgaattacctacactcggaggattcgccgtacttctacccgactgagccgtggaagactaatccggagcacatggctcacgtgaagaaggtgactgctctacaacgactagggactcaaaaagagttgggggaattggtggcatttttggcatctggctcttgtgattatttgactggccaggtgttttggttggcaggcggctttcccctaatagaacgttggcccggcatgcccgaataatgaggatcc

SEQ ID NO: 516 - protein, 254 aa, Artificial
  Synthetic Construct
MSTAIVTNVKHFGGMGSALRLSEAGHTVACHDESFKHKDDLEAFAETYPQLKPMSEQEPAELIEAVTSAYGQVDILVSNDIFAPEFQPIDKYAVEDYRGAVEALQIRPFALVNAVASQMKKRKSGHIIFITSSTPFGPWKELSTYTSARAGACTLANALSKELGEYNVPVFAIGPNYLHSEDSPYFYPTEPWKTNPEHMAHVKKVTALQRLGTQKELGELVAFLASGSCDYLTGQVFWLAGGFPLIERWPGMPE

SEQ ID NO: 517 - DNA, 774 bp, Artificial
  Comment
  CDS (1)..(774)
atgagcaccgctattgtcaccaacgtcaaacattttggaggtatgggtagcgccctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatatcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 518 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDILVSNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 519 - DNA, 774 bp, Artificial
  Comment
  CDS (1)..(774)
atgagcaccgctatcgtcactaacgtcaaacattttggtggtatgggtagcgctctgaggctgagcgaagctggtgataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcccggtcagcaacgatatctttgctccagaatttcagccaatcgataaatacgctgtcgaagattacaggggtgctgtcgaagctctgcagatcaggccatttgctctagtgaatgctgtggcttcacaaatgaagaagcgaaagtcggggcacatcatcttcatcacttcgtctactccgttcgggccgtggaaggagctatcgacttacacttcggctcgagctggggctcgtactctagctaatgctctatcgaaggagctagtagagtacaatatcccggtgttcgcaattttgtctaattacctactctctgaggattcgccgtacttctacccgactgagccgtggaagactaatccggagcacgtggctcacgtgaagaaggtgactgctctacaacgactagggactcaaaaagagttgggggaattggaggcatttttggcatctggctcttgtgattatttgactggccaggtgttttggttggcaggcggctttcccatgatagaacgttggcccggcatgcccgaataatgaggatcc

SEQ ID NO: 520 - protein, 254 aa, Artificial
  Synthetic Construct
MSTAIVTNVKHFGGMGSALRLSEAGDTVACHDESFKQKDELEAFAETYPQLKPMSEQEPAELIEAVTSAYGQVDVPVSNDIFAPEFQPIDKYAVEDYRGAVEALQIRPFALVNAVASQMKKRKSGHIIFITSSTPFGPWKELSTYTSARAGARTLANALSKELVEYNIPVFAILSNYLLSEDSPYFYPTEPWKTNPEHVAHVKKVTALQRLGTQKELGELEAFLASGSCDYLTGQVFWLAGGFPMIERWPGMPE

SEQ ID NO: 521 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcccggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccaaaaaaggagctctcgacttactcttcggctcgagctggggctagtgcactagctaatgctctatcgaaggagctaggagagtacaatatcccggtgttcgctatcgctccgaagtacctacacaccggggattcgccgtaccgctacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 522 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVPVSNDIAPVEWRPIDKYAVEDYRDTVEALQIKPFALVNAVASQMKKRKSGHIIFITSAAPFGPKKELSTYSSARAGASALANALSKELGEYNIPVFAIAPKYLHTGDSPYRYPSEPWKTSPEHVAHVRKVTALQRLGTQKELGELVTFLASGSCDYLTGQVFWLAGGFPVIERWPGMPE

SEQ ID NO: 523 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcatgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtctgcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatga

SEQ ID NO: 524 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVCNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 525 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtctgcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcaaacgttggcccggcatgcccgaataatgaggatcc

SEQ ID NO: 526 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVCNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIKRWPGMPE

SEQ ID NO: 527 - DNA, 774 bp, Artificial
  Comment
  CDS (1)..(774)
atgagcaccgctatcgtcaccaacatcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgaggtcctggtcagcaacgatgtctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 528 - protein, 254 aa, Artificial
  Synthetic Construct
MSTAIVTNIKHFGGMGSALRLSEAGHTVACHDESFKQKDELEAFAETYPQLKPMSEQEPAELIEAVTSAYGQVEVLVSNDVFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 529 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggctccgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 530 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFAPEFQPIDKYAVEDYRGAVEALQIRPFALVNAVAPQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 531 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttggtgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcgtatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 532 - protein, 254 aa, Artificial
  Synthetic Construct
MSTAIVTNVKHFGGMGSALRLSEAGHTVACHDESFKQKDELEAFGETYPQLKPMSEQEPAELIEAVTSAYGQVDVLVSNDIFAPEFQPIDKYAVEDYRGAVEALQIRPFALVNAVASQMKKRKSGRIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 533 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgatctggaagcttttgctgaaacctacccacagctgaaaccaatgagcgaacaggaaccagctgacctgattgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaagcgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccattatcgaacgttggcccggcatgcccgaataatgaggatcc

SEQ ID NO: 534 - protein, 254 aa, Artificial; identical to SEQ ID NO: 124
  Synthetic Construct

SEQ ID NO: 535 - DNA, 774 bp, Artificial
  Comment
  CDS (1)..(774)
atgagcaccgctatcgtcaccaacgtcaaacattttggaggtatgggtagcgctctgaggctgagcgaagctggtctgaccgtcgcttgccatgatgaaagctttaaacagaaagatgaactggaagcttttgctgaagcctacccacagctgaaaccaatgagcgaacaggaaccagctgacctgattgaagctgtcaccagcgcttacggtcaggtcgatgtcctggtcagcaacgatatcttcgctccagaatttcagccaatcgataaatacgctgtcgaagattacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagccggggcgtgtgctctagcgaatgctctatcgaaggagctaggagagtacaatgtgccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccctaatagaacgttggcccggcatgcccgaataatgaggatcc

SEQ ID NO: 536 - protein, 254 aa, Artificial
  Synthetic Construct
MSTAIVTNVKHFGGMGSALRLSEAGLTVACHDESFKQKDELEAFAEAYPQLKPMSEQEPADLIEAVTSAYGQVDVLVSNDIFAPEFQPIDKYAVEDYRGAVEALQIRPFALVNAVASQMKKRKSGHIIFITSATPFGPWKELSTYTSARAGACALANALSKELGEYNVPVFAIGPNYLHSEDSPYFYPTEPWKTNPEHVAHVKKVTALQRLGTQKELGELVAFLASGSCDYLTGQVFWLAGGFPLIERWPGMPE

SEQ ID NO: 537 - DNA, 774 bp, Artificial
  Comment
  CDS (1)..(774)
atgagcaccgctatcgtcaccaacgtcaagcattttggaggtatgggtagcgctctgaggctgagcgaagctggtcataccgtcgcttgccatgatgaaagctttaaacagaaagatgaactgggagcttttgctgaaacctacccacagctgaaaccaatgagcgaacaggaaccagctgaactgatcgaagctgtcaccagcgcttacggtcaggtcgatgtcctggtcagcaacgatatctttgctccagaactgcagccaatcgataaatacgctgtcgaagattacaggggtgctgtcgaagctctgcagatcaggccatttgctctagtgaatgctgtggcttcgcaaatgaagaagcgaaagtcggggcgtatcatcttcatcacttcggctactccgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagagcaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 538 - protein, 254 aa, Artificial
  Synthetic Construct
MSTAIVTNVKHFGGMGSALRLSEAGHTVACHDESFKQKDELGAFAETYPQLKPMSEQEPAELIEAVTSAYGQVDVLVSNDIFAPELQPIDKYAVEDYRGAVEALQIRPFALVNAVASQMKKRKSGRIIFITSATPLGPWKELSTYTSARAGACTLANALSKELGEYNIPVFAIGPNYLHSEDSPYFYPTEPWKSNPEHVAHVKKVTALQRLGTQKELGELVAFLASGSCDYLTGQVFWLAGGFPMIERWPGMPE

SEQ ID NO: 539 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgagctagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgatgaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 540 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDEYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 541 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgatgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 542 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYDVEDYRGTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 543 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcggggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 544 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVGDYRGAVEALQIRPFALVNAVASQMKKRKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 545 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcggggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctaaggtccgtaaggtgactgctctacaacgactagggactcaaaaagagttgggggaattggtgacgtttttggcatctggctcttgtgattatttgactggccaggtgttttggttggcaggcggctttcccgtcatcgatcgttggcccggcatgcccgaataatga

SEQ ID NO: 546 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVGDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAKVRKVTALQRLGTQKELGELVTFLASGSCDYLTGQVFWLAGGFPVIDRWPGMPE

SEQ ID NO: 547 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgataccaatgagcgaacaggaaccagctgaactgattgaagctatcaccagcgctcttggtcaggtcgatgtcctggtcagcaacgatatcgctgctgtggaatggcggccaatcgataaatacgctgtcggggattacaggggtactgtcgaagctctgcagatcaggccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 548 - protein, 254 aa, Artificial
  Synthetic Construct
MSTAIVTNVKHFGGMGSALRLSEAGHTVACHDESFKHQDELEAFAETYPQLIPMSEQEPAELIEAITSALGQVDVLVSNDIAAVEWRPIDKYAVGDYRGTVEALQIRPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFLASGSCDYLTGQVFWLAGGFPVIERWPGMPE

SEQ ID NO: 549 - DNA, 768 bp, Artificial
  Comment
  CDS (1)..(768)
atgagcaccgctattgtcaccaacgtcagacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcggggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgagcgttggcccggcatgcccgaataatga

SEQ ID NO: 550 - protein, 254 aa, Artificial
  Synthetic Construct
MSTAIVTNVRHFGGMGSALRLSEAGHTVACHDESFKHQDELEAFAETYPQLIPMSEQEPAELIEAVTSALGHVDVLVSNDIAPVEWRPIDKYAVGDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 551 - DNA, 774 bp, Artificial
  Comment
  CDS (1)..(774)
atgagcaccgctatcgtcaccaacgtcaaacattttggaggtatgggtagcgctctgaggctgagcgaaggtggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatatgctgtcgaagattacaggggtgctgtcgaagctctgcagatcaggccatttgctctagtgaatgctgtggcttcgcaaatgaagaagcgaaagtcggggcacatcatcttcatcacttcggctgccagtcaggggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 552 - protein, 254 aa, Artificial
  Synthetic Construct
MSTAIVTNVKHFGGMGSALRLSEGGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAASQGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 553 - DNA, 774 bp, Artificial
  Comment
  CDS (1)..(774)
atgagcaccgctatcgtcaccaacgtcaaacattttggaggtatgggtagcgctctgaggctgagcgaaggtggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatatgctgtcgaagattacaggggtgctgtcgaagctctgcagatcaggccatttgctctagtgaatgctgtggcttcgcaaatgaagaagcgaaagtcggggcacatcatcttcatcacttcggctgcccagcgggggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 554 - protein, 254 aa, Artificial
  Synthetic Construct
MSTAIVTNVKHFGGMGSALRLSEGGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAAQRGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 555 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 556 - protein, 254 aa, Artificial; identical to SEQ ID NO: 2
  Synthetic Construct

SEQ ID NO: 557 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgataccaatgagcgaacaggatccagctgaactgattgaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 558 - protein, 254 aa, Artificial
  Synthetic Construct
MSTAIVTNVKHFGGMGSALRLSEAGHTVACHDESFKHQDELEAFAETYPQLIPMSEQDPAELIEAVTSALGQVDVLVSNDIAAVEWRPIDKYAVEDYRGTVEALQIKPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFLASGSCDYLTGQVFWLAGGFPVIERWPGMPE

SEQ ID NO: 559 - DNA, 768 bp, Artificial
  Comment
  CDS (1)..(768)
atgagcaccgctattgtcacgaacgtcaaacattttggaggtatgggtagcgctctgaggctgagcgaagctggtcataccgtcgcttgccatgatgaaagctttaagcataaagatgaactggaagcttttgctgaaacctacccacagctgataccaatgagcgaacaggaaccagctgaactgattgaagctgtcaccagcgctttcggtcaggtcgatgtcctggtcagcaacgatatctatgctctacaatttcgtccaatcgataaatacgctgtcgaggattacaggggtgctgtcgaagctctgcaggtcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 560 - protein, 254 aa, Artificial
  Synthetic Construct
MSTAIVTNVKHFGGMGSALRLSEAGHTVACHDESFKHKDELEAFAETYPQLIPMSEQEPAELIEAVTSAFGQVDVLVSNDIYALQFRPIDKYAVEDYRGAVEALQVRPFALVNAVASQMKKRKSGHIIFITSAAPFGPWKELSTYSSARAGTSALANALSKELGEYNIPVFAIGPNYLHSEDSPYYYPTEPWKINPEHVAHVKKVTALQRLGTQKELGELVTFLASGSCDYLTGQVFWLAGGFPVIERWPGMPE

SEQ ID NO: 561 - DNA, 768 bp, Artificial
  Comment
  CDS (1)..(768)
atgagcaccgctgtcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctctagaatttcggccaatcgataaatacgctgtcgaagattacaggggtgctgtcgaagctctgcagatcaggccatttgctctagtgaatgctgtggcttcccaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattgatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccacgatagaacgttggcccggcatgcccgaataatga

SEQ ID NO: 562 - protein, 254 aa, Artificial
  Synthetic Construct
MSTAVVTNVKHFGGMGSALRLSEAGHTVACHDESFKQKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSPYYYPTEPWKIDPEHVAHVKKVTALQRLGTQKELGELVAFLASGSCDYLTGQVFWLAGGFPTIERWPGMPE

SEQ ID NO: 563 - DNA, 768 bp, Artificial
  Comment
  CDS (1)..(768)
atgaacaccgctattgtcaccaacgtcaaacattttggaggtatgggtagcgctctgaggctgagcgaagctggtcataccgtcgcttgccatgatgaaagctttaagcataaagatgaactggaagcttttgctgaagcctacccacagctgataccaatgagcgaacaggaaccagctgaactgattgaagctgtcaccagcgcttttggtcatgtcgatgtcctggtcagcaacgatatctttgccctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacctcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattacccctctgatccgtggaagactaatccggagcacgtggctcacgtgaagaaggtgactgctctacaacgactagggactcaaaaagagttgggggaattggtgacatttttggcatctggctcttgtgattatttgactggccaggtgttttggttggcaggcggctttcccgtcatagaacgttggcccggcatgcccgaataatga

SEQ ID NO: 564 - protein, 254 aa, Artificial
  Synthetic Construct
MNTAIVTNVKHFGGMGSALRLSEAGHTVACHDESFKHKDELEAFAEAYPQLIPMSEQEPAELIEAVTSAFGHVDVLVSNDIFALEFRPIDKYAVEDYRGAVEALQIRPFALVNAVASQMKKRKSGHIIFITSAAPFGPWKELSTYSSARAGTSALANALSKELGEYNIPVFAIGPNYLHSEDSPYYYPSDPWKTNPEHVAHVKKVTALQRLGTQKELGELVTFLASGSCDYLTGQVFWLAGGFPVIERWPGMPE

SEQ ID NO: 565 - DNA, 774 bp, Artificial
  Comment
  CDS (1)..(774)
atgaccaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatttttgctccagaatttcgtccaatcgataaatacgctgtcgaagattacaggggtgctgtcgaagctctgcagatcaggccatttgctctagtgaatgctgtggcttcgcaaatgaagaagcgaaagtcggggcgtatcatcttcatcacttcggctactctgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 566 - protein, 254 aa, Artificial
  Synthetic Construct
MTTAIVTNVKHFGGMGSALRLSEAGHTVACHDESFKQKDELEAFAETYPQLKPMSEQEPAELIEAVTSAYGQVDVLVSNDIFAPEFRPIDKYAVEDYRGAVEALQIRPFALVNAVASQMKKRKSGRIIFITSATLLGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 567 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcatggtcagcaacgatatctttgctccagaatttcagccaatcgataaatacgctgtcgaagattacaggggtgctgtcgaagctctgcagatcaggccatttgctctagtgaatgctgtggctgcgcaaatgaagaaacgaaagtcggggcacatcatcttcatcacttcggctactccgttcgggccatggaaggagctatcgacttacacttcggctcgagccggggcgtgtgctctagcgaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactggtctacaacgactagggactcaaaaagagttgggggaattggtggcatttttggcatctggctcttgtgattatttgactggccaggtgttttggttggcaggcggctttcccatgatagaacgctggcccgttatgcccgaataatgaggatcc

SEQ ID NO: 568 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVMVSNDIFAPEFQPIDKYAVEDYRGAVEALQIRPFALVNAVAAQMKKRKSGHIIFITSATPFGPWKELSTYTSARAGACALANALSKELGEYNIPVFAIGPNYLHSEDSPYFYPTEPWKTNPEHVAHVKKVTGLQRLGTQKELGELVAFLASGSCDYLTGQVFWLAGGFPMIERWPVMPE

SEQ ID NO: 569 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaggattaccgtggtgctgatgaagctctgcagatcaggccatttgctctagtgaatgctgtggcttcgcaaatgaagaagcgaaagtcggggcacatcatcttcatcacttcggctactccgttcgggccatggaaggagctatcgacttgcacttcggctcgagctggggcttgtactctagctaatgctctatcgaaggagctaggagagtacaatatcccggtgttcgctatcgggccgaattacctacactcggaggattcgccgtacttctacccgagcgagccgtggaagactaatccggagcacgtggctcacgtgaagaaggtgactgctctacaacgactagggactcaaaaagagttgggggaattggtggcatttttggcatctggctcttgtgattatctgactggccaggtgtgctggctggcaggcggctttccgatgatagaacgttggcccggcatgcccgaataatgaggatcc

SEQ ID NO: 570 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGADEALQIRPFALVNAVASQMKKRKSGHIIFITSATPFGPWKELSTCTSARAGACTLANALSKELGEYNIPVFAIGPNYLHSEDSPYFYPSEPWKTNPEHVAHVKKVTALQRLGTQKELGELVAFLASGSCDYLTGQVCWLAGGFPMIERWPGMPE

SEQ ID NO: 571 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 572 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAAPFGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 573 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgggcgaacaggaaccagctgaactgatcgaagctgtcaccagcgcttacggtcaggtcgatgtcctggtcagcaacgatatctttgctccagaactgcagccaatcgataaatacgctgtcgaagattacaggggtgctgtcgaagctctgcagatcaggccatttgctgttgtgaatgctgtggcttcgcaaatgaagaagcgaaagtcggggcacatcatcttcatcacttcggctactccgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactggtctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 574 - protein, 254 aa, Artificial
  Synthetic Construct
MSTAIVTNVKHFGGMGSALRLSEAGHTVACHDESFKQKDELEAFAETYPQLKPMGEQEPAELIEAVTSAYGQVDVLVSNDIFAPELQPIDKYAVEDYRGAVEALQIRPFAVVNAVASQMKKRKSGHIIFITSATPLGPWKELSTYTSARAGACTLANALSKELGEYNIPVFAIGPNYLHSEDSPYFYPTEPWKTNPEHVAHVKKVTGLQRLGTQKELGELVAFLASGSCDYLTGQVFWLAGGFPMIERWPGMPE

SEQ ID NO: 575 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgatctggaagcttttgctgaaacctacccacagctgaaaccaatgagcgaacaggaaccagctgaactgattgaagctgtcaccagcgcttacggtcaggtcgatgtcctggtcagcaacgatatctttgctccagaatctcagccaatcgataaatacgctgtcgaagattacaggggtgctgtcgaagctctgcagatcaggccatttgctctagtgaatgctgtggcttcgcaaatgaagaaacgaaagtcggggcacatcatcttcatcacttcgtctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccctaatagaacgttggcccggcatgcccgaataatgaggatcc

SEQ ID NO: 576 - protein, 254 aa, Artificial
  Synthetic Construct
MSTAIVTNVKHFGGMGSALRLSEAGHTVACHDESFKQKDDLEAFAETYPQLKPMSEQEPAELIEAVTSAYGQVDVLVSNDIFAPESQPIDKYAVEDYRGAVEALQIRPFALVNAVASQMKKRKSGHIIFITSSTPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPLIERWPGMPE

SEQ ID NO: 577 - DNA, 774 bp, Artificial
  Comment
  CDS (1)..(774)
atgagcaccgctatcgtcaccaacgtcaaacattttggaggtatgggtagcgctctgaggctgagcgaaggtggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatatgctgtcgaagattacaggggtgctgtcgaagctctgcagatcaggccatttgctctagtgaatgctgtggcttcgcaaatgaagaagcgaaagtcggggcacatcatcttcatcacttcggctgcccaggaggggccatggaaggagctatcgacttacacttcggctcgagctggggctagtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 578 - protein, 254 aa, Artificial
  Synthetic Construct
MSTAIVTNVKHFGGMGSALRLSEGGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAAQEGPWKELSTYTSARAGASTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 579 - DNA, 774 bp, Artificial
  Comment
  CDS (1)..(774)
atgagcaccgctatcgtcaccaacgtcaaacattttggaggtatgggtagcgctctgtggctgagcgaagctggtcataccgtcgcttgccatgatgaaagctttgaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgcagtcgaagctctgcagatcaggccatttgctctagtgaatgctgtggctccgcaaatgaagaaacgaaagtcggggcacatcatcttcatcacttcggctactccgttcgggccatggaaggagctatcgacttacacttcggctcgagctggggccagtactctagctaatgctctatcgaaggagctaggagagtacaatatcccggtgttcgctatcgggccgaattacctacactcggaggattcgccgtacttctacccgactgagccgtggaagactgatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 580 - protein, 254 aa, Artificial
  Synthetic Construct
MSTAIVTNVKHFGGMGSALWLSEAGHTVACHDESFEQKDELEAFAETYPQLKPMSEQEPAELIEAVTSAYGQVDVLVSNDIFAPEFQPIDKYAVEDYRGAVEALQIRPFALVNAVAPQMKKRKSGHIIFITSATPFGPWKELSTYTSARAGASTLANALSKELGEYNIPVFAIGPNYLHSEDSPYFYPTEPWKTDPEHVAHVKKVTALQRLGTQKELGELVAFLASGSCDYLTGQVFWLAGGFPMIERWPGMPE

SEQ ID NO: 581 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccgatgcgtgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggatggcaggcggctttcccatgatagaacgttggcccggcatgcccgaataatgaggatcc

SEQ ID NO: 582 - protein, 254 aa, Artificial
  Synthetic Construct
MSTAIVTNVKHFGGMGSALRLSEAGHTVACHDESFKQKDELEAFAETYPQLKPMREQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWMAGGFPMIERWPGMPE

SEQ ID NO: 583 - DNA, 774 bp, Artificial
  Comment
  CDS (1)..(774)
atgagcaccgctattgtcaccaacgtcaaacattttggaggtatgggtagcgctctgaagctgagcgaagctggtcataccgtcgcttgccatgatgaaagctttaaacagaaagatgatctggaagcttttgctgaagcctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctagctaatgctctatcgaaggagctaggagagtacaatgtgccggtgttcgctatcgggccgaattacctgcactcggaggattcgccgtacttctacccgactgagccgtggaagactaatccggagcacgtggctcacgtgaagaaggtgactgctctacaacgactagggactcaaaaagagttgggggaactggtggcattcctggcatctggctcttgtgattatttgactggccaggtgttttggttggcaggcggctttcccctaatagaacgttggcccggcatgcccgaataatgaggatcc

SEQ ID NO: 584 - protein, 254 aa, Artificial
  Synthetic Construct
MSTAIVTNVKHFGGMGSALKLSEAGHTVACHDESFKQKDDLEAFAEAYPQLKPMSEQEPAELIEAVTSAYGQVDVLVSNDIFAPEFQPIDKYAVENYRGAVEALQIRPFALVNAVASQMKKRKSGHIIFITSATPFGPWKELSTYTSARAGACTLANALSKELGEYNVPVFAIGPNYLHSEDSPYFYPTEPWKTNPEHVAHVKKVTALQRLGTQKELGELVAFLASGSCDYLTGQVFWLAGGFPLIERWPGMPE

SEQ ID NO: 585 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatggtgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaagatgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 586 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNGVASQMKKRKSGHIIFITSAAPFGPWKELSTYSSARAGASALANALSKELGEYNIPVFAIAPNYLHSGDSPYYYPSEPWKTSPEHVAHVRKMTALQRLGTQKELGELVTFLASGSCDYLTGQVFWLAGGFPVIERWPGMPE

SEQ ID NO: 587 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgtatgctgccgcttcgcaaatgaagaagcgaaaggcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggctggcaggcggctttcccgttatcgaacgttggcccggcatgcccgaataatga

SEQ ID NO: 588 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVYAAASQMKKRKAGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 589 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaacaagccaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccgggatgcccgaataatgaggatcc

SEQ ID NO: 590 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMNKPKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 591 - DNA, 768 bp, Artificial
  Comment
  CDS (1)..(768)
atgaagcccgctattgtcaccaacgtcaaacattttggaggtatgggtagcgctctgaaactgagcgaagctggtcataccgtcgcttgccatgatgaaagctttaagcataaagatgaactggaagcttttgctgaaacctacccacagctgcgtccaatgagcgaacaggaaccagctgaactgattgaagctgtcaccagcgcttttggtcatgtcgatgtcctggtcagcaacgatatcgctgctgtggaatggcggccaatcgataaatacgctgtcgaggattacaggggtgttgtcgaagctctgcagatcaagccatttgctctagtgaatgctgtggcttcgcaaatgaaggagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgctccgaattacctacactcggaggattcgccgtactattaccccactgagccgtggaagattaatccggagcacgtgactcacgtgcgtaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 592 - protein, 254 aa, Artificial
  Synthetic Construct
MKPAIVTNVKHFGGMGSALKLSEAGHTVACHDESFKHKDELEAFAETYPQLRPMSEQEPAELIEAVTSAFGHVDVLVSNDIAAVEWRPIDKYAVEDYRGVVEALQIKPFALVNAVASQMKERKSGHIIFITSAAPFGPWKELSTYSSARAGTSALANALSKELGEYNIPVFAIAPNYLHSEDSPYYYPTEPWKINPEHVTHVRKVTALQRLGTQKELGELVAFLASGSCDYLTGQVFWLAGGFPVIERWPGMPE

SEQ ID NO: 593 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaaggagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgactatttgactggccaggtgttttggttgagcggcggctttcccgtcatagaacgttggcccggcatgcccgaataatga

SEQ ID NO: 594 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKERKSGHIIFITSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLSGGFPVIERWPGMPE

SEQ ID NO: 595 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaaggagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaaaacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcaaacgttggcccggcatgcccgaataatgaggatcc

SEQ ID NO: 596 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMKERKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIKRWPGMPE

SEQ ID NO: 597 - DNA, 768 bp, Artificial
  Comment
  CDS (1)..(768)
atgagcaccgttattgtcaccaatgtcaaacattttggaggtatgggtgcggctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaaggagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgccatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 598 - protein, 254 aa, Artificial
  Synthetic Construct
MSTVIVTNVKHFGGMGAALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKERKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 599 - DNA, 774 bp, Artificial
  Comment
  CDS (1)..(774)
atgagcaccgctatcgtcaccacggtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtctatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagccaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaaggaggtgattgctctacaacgactagggactcaaaaagagttgggggaattggtggcatttttggcatctggctcttgtgattatctgactgtgcaggtggtgtggctggcaggcggctttccgatgatcgaacgttggccgggcatgcccgaataatgaggatcc

SEQ ID NO: 600 - protein, 254 aa, Artificial
  Synthetic Construct
MSTAIVTTVKHFGGMGSALRLSEAGHTVACHDESFKQKDELEAFAETYPQLKPMSEQEPAELIEAVTSAYGQVYVLVSNDIFAPEFQPIDKYAVEDYRGAVEALQIRPFALVNAVASQMKKPKSGHIIFITSATPFGPWKELSTYTSARAGACTLANALSKELGEYNIPVFAIGPNYLHSEDSPYFYPTEPWKTNPEHVAHVKEVIALQRLGTQKELGELVAFLASGSCDYLTVQVVWLAGGFPMIERWPGMPE

SEQ ID NO: 601 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggagccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcgtcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 602 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFVTSAAPFGPWKELSTYSSARAGASALANALSKELGEYNIPVFAIGPNYLHSEDSPYYYPTEPWKINPEHVAHVKKVTALQRLGTQKELGELVAFLASGSCDYLTGQVFWLAGGFPVIERWPGMPE

SEQ ID NO: 603 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgcaccgttcgggccacataaggagatctcgacttactcttcggcccgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 604 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAAPFGPHKEISTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 605 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgcaccgttcgggccacataaggagctctcgacttactcttcggctcgagctggggctagtgcactagctaatgctctatcgaaggagctaggagagtacaatatcccggtgttcgctatcgctccgaagtacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 606 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAAPFGPHKELSTYSSARAGASALANALSKELGEYNIPVFAIAPKYLHSGDSPYYYPSEPWKTSPEHVAHVRKVTALQRLGTQKELGELVTFLASGSCDYLTGQVFWLAGGFPVIERWPGMPE

SEQ ID NO: 607 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccacataaggaggtctcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 608 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAAPFGPHKEVSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 609 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgatcccaatgagcgaacaggaaccagctgaactgattgaagctgtcaccagcgctcttggtcaggtcgatgtcctggtcagcaacgatatctatcctgtggaatggcggccaatcgataaatacgctgtcgaggattacaggggtactgtcgaagctctacagatcaagccatttgctctagtgaatgctgtcgcttcgcaaatgaagaagcgaaagtcggggcacatcatcttcatcacttcggctgcaccgttcgggccacataaggagatctcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagctgggggaattggtggcatttttggcatctggctcttgtgattatttgactggccaggtgttttggttgacaggcggctttcccgtcatcgaacgttggcccggcatgcccgaataatga

SEQ ID NO: 610 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGQVDVLVSNDIYPVEWRPIDKYAVEDYRGTVEALQIKPFALVNAVASQMKKRKSGHIIFITSAAPFGPHKEISTYSSARAGASALANALSKELGEYNIPVFAIAPNYLHSGDSPYYYPSEPWKTSPEHVAHVRKVTALQRLGTQKELGELVAFLASGSCDYLTGQVFWLTGGFPVIERWPGMPE

SEQ ID NO: 611 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaaggtttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctggaccgttcgggccacataaggaggtctcgacttactcttcggctcgagctggggctagtgcactagctaatgctctatcgaaagagctaggagagtacaatatcccggtgttcgctatcgctccggagtacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactgaccaggtgttttggttggcaggcggctttcccgtcatcgaacgttggcccggcatgcccgaataatgaggatcc

SEQ ID NO: 612 - protein, 254 aa, Artificial
  Synthetic Construct
MSTAIVTNVKHFGGMGSALRLSEAGHTVACHDERFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAGPFGPHKEVSTYSSARAGASALANALSKELGEYNIPVFAIAPEYLHSGDSPYYYPSEPWKTSPEHVAHVRKVTALQRLGTQKELGELVTFLASGSCDYLTDQVFWLAGGFPVIERWPGMPE

SEQ ID NO: 613 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacccacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgcaccgttcgggccatggaaggagatctcgacttactcttcggctcgagctggggctagtgcactagctaatgctctatcgaaggagctaggagagtacaatatcccggtgttcgctatcgctccgaattacctacacaccggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 614 - protein, 254 aa, Artificial
  Synthetic Construct
MSTAIVTNVKHFGGMGSALRLSEAGHTVACHDESFKHQDELEAFAETHPQLIPMSEQEPAELIEAVTSALGHVDVLVSNDIAPVEWRPIDKYAVEDYRDTVEALQIKPFALVNAVASQMKKRKSGHIIFITSAAPFGPWKEISTYSSARAGASALANALSKELGEYNIPVFAIAPNYLHTGDSPYYYPSEPWKTSPEHVAHVRKVTALQRLGTQKELGELVTFLASGSCDYLTGQVFWLAGGFPVIERWPGMPE

SEQ ID NO: 615 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgagcaggaaccagctgaactgattgaagctgtcaccagcgctcttggtcatgtcgatgtcctggtcagcaacgacatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccaaaaaaggagatctcgacttactcttcggctcgagctggggctagtgcactggctaatgctctatcgaaggagctaggagagtacaatatcccggtgttcgctatcgctccgaattacctacacagcggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 616 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAAPFGPKKEISTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 617 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgatcccaatgagcgaacaggaaccagctgaactgattgaagctgtcaccagcgctcttggtcaggtcgatgtcctggtcagcaacgatatctatcctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccaaaaaaggagatctcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagctgggggaattggtggcatttttggcatctggctcttgtgattatttgactggccaggtgttttggttgacaggcggctttcccgtcatcgaacgttggcccggcatgcccgaataatga

SEQ ID NO: 618 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGQVDVLVSNDIYPVEWRPIDKYAVEDYRGTVEALQIKPFALVNAVASQMKKRKSGHIIFITSAAPFGPKKEISTYSSARAGASALANALSKELGEYNIPVFAIAPNYLHSGDSPYYYPSEPWKTSPEHVAHVRKVTALQRLGTQKELGELVAFLASGSCDYLTGQVFWLTGGFPVIERWPGMPE

SEQ ID NO: 619 - DNA, 774 bp, Artificial
  Comment
  CDS (1)..(774)
atgagcaccgctatcgtcaccaacgtcaaacattttggaggtatgggtagcgctctgaggctaagcgaagctggtctgaccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttgaccggcggctttcccatgatagaacgttgggccggcatgcccgaataatgaggatcc

SEQ ID NO: 620 - protein, 254 aa, Artificial
  Synthetic Construct
MSTAIVTNVKHFGGMGSALRLSEAGLTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLTGGFPMIERWAGMPE

SEQ ID NO: 621 - DNA, 765 bp, Artificial
  Comment
  CDS (1)..(765)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgagttacacttcggctcgagctggggcttgttccctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataa

SEQ ID NO: 622 - protein, 254 aa, Artificial; identical to SEQ ID NO: 48
  Synthetic Construct

SEQ ID NO: 623 - DNA, 771 bp, Artificial
  Comment
  CDS (1)..(771)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccagtggacaaatactcagtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgagga

SEQ ID NO: 624 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPVDKYSVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 625 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctttccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatgtgccggtgttcgctatcgggccgaattacctacactcggaggattcgccgtacttccacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 626 - protein, 254 aa, Artificial
  Synthetic Construct
MSTAIVTNVKHFGGMGSALRLSEAGHTVACHDESFKQKDELEAFAETFPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNVPVFAIGPNYLHSEDSPYFHPTEPWKTNPEHVAHVKKVTALQRLGTQKELGELVAFLASGSCDYLTGQVFWLAGGFPMIERWPGMPE

SEQ ID NO: 627 - DNA, 768 bp, Artificial
  Comment
  CDS (1)..(768)
atgaacaccgctattgtcacgaacgtcaaacattttggaggtatgggtagcgctctgcgtctgagcgaagctggtcataccgtcgcttgccatgatgaaagctttaagcatcaggatgaactggaagcttttgctgacgcctacccacagctgataccaatgagcgaacaggaaccagctgaactgattgaagctgtcaccagcgcttatggtcaggtcgatgtcctggtcagcaacgatatcgctgctgtggaatggcggccaatcgataaatacgctgtcgaggattacaggggtgttgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgctccgaattacctacactcggaggattcgccgtactattacccctctgagccgtggaagactaatccggagcacgtggctcacgtgcgtaaggtgactgctctacgtcgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 628 - protein, 254 aa, Artificial
  Synthetic Construct
MNTAIVTNVKHFGGMGSALRLSEAGHTVACHDESFKHQDELEAFADAYPQLIPMSEQEPAELIEAVTSAYGQVDVLVSNDIAAVEWRPIDKYAVEDYRGVVEALQIRPFALVNAVASQMKKRKSGHIIFITSAAPFGPWKELSTYSSARAGTSALANALSKELGEYNIPVFAIAPNYLHSEDSPYYYPSEPWKTNPEHVAHVRKVTALRRLGTQKELGELVTFLASGSCDYLTGQVFWLAGGFPVIERWPGMPE

SEQ ID NO: 629 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggtcaggtgttttggttggcaggcggctttcccgtcatagaacgttggcccggcatgcccgaataatga

SEQ ID NO: 630 - protein, 254 aa, Artificial; identical to SEQ ID NO: 200
  Synthetic Construct

SEQ ID NO: 631 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgcgtccaatgagcgaacaggaaccagctgaactgattgaagctgtcaccagcgcttttggtcatgtcgatgtcctggtcagcaacgatatcgctgctgtggaatggcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgctccgaattacctacactcggaggattcgccgtactattacccctctgagccgtggaagactaatccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 632 - protein, 254 aa, Artificial
  Synthetic Construct
MSTAIVTNVKHFGGMGSALRLSEAGHTVACHDESFKHKDELEAFAETYPQLRPMSEQEPAELIEAVTSAFGHVDVLVSNDIAAVEWRPIDKYAVEDYRGAVEALQIRPFALVNAVASQMKKRKSGHIIFITSAAPFGPWKELSTYSSARAGTSALANALSKELGEYNIPVFAIAPNYLHSEDSPYYYPSEPWKTNPEHVAHVRKVTALQRLGTQKELGELVTFLASGSCDYLTGQVFWLAGGFPVIERWPGMPE

SEQ ID NO: 633 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgacacctacccacagctgataccaatgagcgaacaggaaccagctgaactgattgaagctgtcaccagcgcttttggtcaggtcgatgtcctggtcagcaacgatatcgctgctgtggaatggcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtggcatttttggcatctggctcttgtgattatttgactggccaggtgttttggttggcaggcggctttcccgtcatcgaacgttggcccggcatgcccgaataatga

SEQ ID NO: 634 - protein, 254 aa, Artificial
  Synthetic Construct
MSTAIVTNVKHFGGMGSALRLSEAGHTVACHDESFKHKDELEAFADTYPQLIPMSEQEPAELIEAVTSAFGQVDVLVSNDIAAVEWRPIDKYAVEDYRGAVEALQIRPFALVNAVASQMKKRKSGHIIFITSAAPFGPWKELSTYSSARAGTSALANALSKELGEYNIPVFAIAPNYLHSEDSPYYYPSEPWKTSPEHVAHVRKVTALQRLGTQKELGELVAFLASGSCDYLTGQVFWLAGGFPVIERWPGMPE

SEQ ID NO: 635 - DNA, 768 bp, Artificial
  Comment
  CDS (1)..(768)
atgagcaccgctattgtcaccaacgtcaaacattttggaggtatgggtagcgctctgcgtctgagcgaagctggtcataccgtcgcttgccatgatgaaagctttaagcataaagatgaactggaagcttttgctgacgcctacccacagctgataccaatgagcgaacaggaaccagctgaactgattgaagctgtcaccagcgcttttggtcaggtcgatgtcctggtcagcaacgatatcattgctctagaatttcagccaatcgataaatacgctgtcgaggattacaggggtgttgtcgaagctctgcaggtccgcccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgggccgaattacctacactcggaggattcgccgtactattaccccactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 636 - protein, 254 aa, Artificial
  Synthetic Construct
MSTAIVTNVKHFGGMGSALRLSEAGHTVACHDESFKHKDELEAFADAYPQLIPMSEQEPAELIEAVTSAFGQVDVLVSNDIIALEFQPIDKYAVEDYRGVVEALQVRPFALVNAVASQMKKRKSGHIIFITSAAPFGPWKELSTYSSARAGTSALANALSKELGEYNIPVFAIGPNYLHSEDSPYYYPTEPWKTNPEHVAHVKKVTALQRLGTQKELGELVAFLASGSCDYLTGQVFWLAGGFPVIERWPGMPE

SEQ ID NO: 637 - DNA, 768 bp, Artificial
  Comment
  CDS (1)..(768)
atgagcgccgctattgtcacgaacgtcaaacattttggaggtatgggtagcgctctgaaactgagcgaagctggtcataccgtcgcttgccatgatgaaagctttaagcatcaggatgaactggaagcttttgctgacacctacccacagctgcgtccaatgagcgaacaggaaccagctgaactgattgaagctgtcaccagcgcttatggtcaggtcgatgtcctggtcagcaacgatatctatgctctagaatttcgtccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctgggactagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaacgcgagttgggggaattggtggcatttttggcatctggctcttgtgattatttgactggccaggtgttttggttggcaggcggctttcccgtcctcgaacgttggcccggcatgcccgaataatga

SEQ ID NO: 638 - protein, 254 aa, Artificial
  Synthetic Construct
MSAAIVTNVKHFGGMGSALKLSEAGHTVACHDESFKHQDELEAFADTYPQLRPMSEQEPAELIEAVTSAYGQVDVLVSNDIYALEFRPIDKYAVEDYRGAVEALQIRPFALVNAVASQMKKRKSGHIIFITSAAPFGPWKELSTYSSARAGTSALANALSKELGEYNIPVFAIAPNYLHSEDSPYYYPSEPWKTSPEHVAHVRKVTALQRLGTQRELGELVAFLASGSCDYLTGQVFWLAGGFPVLERWPGMPE

SEQ ID NO: 639 - DNA, 774 bp, Artificial
  Comment
  CDS (1)..(774)
atgagcaccgctatcgtcaccaacatcaaacattttggaggtatgggtagcgctctgaggctgagcgaagctggtcataccgtcgcttgccatgatgaaagctttaaacagaaagatgaactggaagcttttgctgaaacctacccacagctgcggccaatgagcgaacaggaaccagctgacatgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 640 - protein, 254 aa, Artificial
  Synthetic Construct
MSTAIVTNIKHFGGMGSALRLSEAGHTVACHDESFKQKDELEAFAETYPQLRPMSEQEPADMIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 641 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctgctccgttcgggccatggaaggagctatcgacttacacttcggctcgagctggggcttgttccctagctaatgctctagctaaggagctaggagagtacaatatcccggtgttcgctatcgggccgaattacctacactcggaggattcgccgtacttctacccgactgagccgtggaagactaatccggagcacgtggctcacgtgaagaaggtgactgctctacgacgactagggactcaagaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 642 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIRPFALVNAVASQMKKRKSGHIIFITSAAPFGPWKELSTYTSARAGACSLANALAKELGEYNIPVFAIGPNYLHSEDSPYFYPTEPWKTNPEHVAHVKKVTALRRLGTQEELGELVAFLASGSCDYLTGQVFWLAGGFPMIERWPGMPE

SEQ ID NO: 643 - DNA, 768 bp, Artificial
  Comment
  CDS (1)..(768)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatga

SEQ ID NO: 644 - protein, 254 aa, Artificial; identical to SEQ ID NO: 2
  Synthetic Construct

SEQ ID NO: 645 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgatctggaagcttttgctgaaacctacccacagctgaaaccaatgagcgaacaggatccagctgacctgattgaagctgtcaccagcgcttacggtcaggtcgatgtcctggtcagcaacgatatctttgctccagaatttcagccaatcgataaatacgctgtcgaaaactacaggggtgctgtcgaagctctgcagatcaggccatttgctctagtgaatgctgtggcttcgcaaatgaagaaacgaaagtcggggcacatcatcttcatcacttcggctactccgttcgggccatggaaagagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcattcctggcatctggctcttgtgattatttgactggccaggtgttttggttggcaggcggctttcccattatcgaacgttggcccggcatgcccgaataatgaggatcc

SEQ ID NO: 646 - protein, 254 aa, Artificial
  Synthetic Construct
MSTAIVTNVKHFGGMGSALRLSEAGHTVACHDESFKQKDDLEAFAETYPQLKPMSEQDPADLIEAVTSAYGQVDVLVSNDIFAPEFQPIDKYAVENYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPIIERWPGMPE

SEQ ID NO: 647 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagggtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 648 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGGYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 649 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccgatgcgtgaacaggaaccagctgaactgatcgaagctgtcaccagcgcttacggtcaggtcgatgtcctggtcagcaacgacatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggatggcaggcggctttcccatgatagaacgttggcccggcatgcccgaataatgaggatcc

SEQ ID NO: 650 - protein, 254 aa, Artificial; identical to SEQ ID NO: 582
  Synthetic Construct

SEQ ID NO: 651 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcaccgtgtacgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgactatttgactggccaggtgttttggttggcaggcggctttcccgtcatagaacgttggcccggcatgcccggataatga

SEQ ID NO: 652 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNITVYAIGPNYLHSEDSPYYYPTEPWKINPEHVAHVKKVTALQRLGTQKELGELVAFLASGSCDYLTGQVFWLAGGFPVIERWPGMPG

SEQ ID NO: 653 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcaccgtgtacgctatcgggccgaattacctacactcggaggattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 654 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNITVYAIGPNYLHSEDSPYYYPTEPWKINPEHVAHVKKVTALQRLGTQKELGELVAFLASGSCDYLTGQVFWLAGGFPVIERWPGMPE

SEQ ID NO: 655 - DNA, 696 bp, Artificial
  Comment
  CDS (1)..(696)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcatgtactctagctaatgctctatcgaaggagctaggagagtacaatatcccggtgttcgctatcgggccgcattttctaaactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttg

SEQ ID NO: 656 - protein, 232 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPHFLNSEDSPYFYPTEPWKTNPEHVAHVKKVTALQRLGTQKELGELVAFLASGSCDYL

SEQ ID NO: 657 - DNA, 696 bp, Artificial
  Comment
  CDS (1)..(696)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattttctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttg

SEQ ID NO: 658 - protein, 232 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNFLHSEDSPYFYPTEPWKTNPEHVAHVKKVTALQRLGTQKELGELVAFLASGSCDYL

SEQ ID NO: 659 - DNA, 696 bp, Artificial
  Comment
  CDS (1)..(696)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattttctacagtcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttg

SEQ ID NO: 660 - protein, 232 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNFLQSEDSPYFYPTEPWKTNPEHVAHVKKVTALQRLGTQKELGELVAFLASGSCDYL

SEQ ID NO: 661 - DNA, 696 bp, Artificial
  Comment
  CDS (1)..(696)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgcattttctaaactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttg

SEQ ID NO: 662 - protein, 232 aa, Artificial; identical to SEQ ID NO: 656
  Synthetic Construct

SEQ ID NO: 663 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccagtgttcgctatcgggccaaactttctacactcggaggattcgaagtactattaccccactgagccgtggaagattaatccggagcacgtggctcacgtgaagaaggtgactgctctacaacgactagggactcaaaaagagttgggggaattggtggcatttttggcatctggctcttgtgactatttgactggccaggtgttttggttggcaggcggctttcccgtcatagaacgttggcccggcatgcccgaataatga

SEQ ID NO: 664 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNFLHSEDSKYYYPTEPWKINPEHVAHVKKVTALQRLGTQKELGELVAFLASGSCDYLTGQVFWLAGGFPVIERWPGMPE

SEQ ID NO: 665 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgatcgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccacgtaaggaggtctcgacttactcttcggctcgagctggggctagtgcactagctaatgctctatcgaaggagctaggagagtacaatatcccggtgttcgctatcgctccgcgttacctacacatcggggattcgccgtaccgctacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 666 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAAPFGPRKEVSTYSSARAGASALANALSKELGEYNIPVFAIAPRYLHIGDSPYRYPSEPWKTSPEHVAHVRKVTALQRLGTQKELGELVTFLASGSCDYLTGQVFWLAGGFPVIERWPGMPE

SEQ ID NO: 667 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctggaccgttcgggccacgtaaggaggtctcgacttactcttcggctcgagctggggctagtgcactagctaatgctctatcgaaggagctaggagagtacaatatcccggtgttcgctatcgctccgcgttacctacacaccggggattcgccgtactggtacccctctgagccgtggaagacttctccggagcacgtggctcacgtgcgtaaggtgactgctctacaacgactagggactcaaaaagagttgggggaattggtgacgtttttggcatctggctcttgtgattatctgactggccaggtgttttggttggcaggcggctttcccgtcatcgaacgttggcccggcatgcccgaataatgaggatcc

SEQ ID NO: 668 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAGPFGPRKEVSTYSSARAGASALANALSKELGEYNIPVFAIAPRYLHTGDSPYWYPSEPWKTSPEHVAHVRKVTALQRLGTQKELGELVTFLASGSCDYLTGQVFWLAGGFPVIERWPGMPE

SEQ ID NO: 669 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattggagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggaggtctcgacttactcttcggctcgagctggggctagtgcactagctaatgctctatcgaaggagctaggagagtacaatatcccggtgttcgctatcgctccgaattacctacacaccggggattcgccgtactattacccctctgagccgtggaagacttctccggagcacgtggctcacgtgcgtaaggtgactgctctacaacgactagggactcaaaaagagttgggggaattggtaacgtttttggcatctggctcttgtgattatttgactggccaggtgttttggttggcaggcggctttcccgtcatcgaacgttggcccggcatgcccgaataatgaggatcc

SEQ ID NO: 670 - protein, 254 aa, Artificial
  Synthetic Construct
MSTAIVTNVKHFGGMGSALRLSEAGHTVACHDESFKHQDELEAFAETYPQLIPMSEQEPAELIGAVTSALGHVDVLVSNDIAPVEWRPIDKYAVEDYRDTVEALQIKPFALVNAVASQMKKRKSGHIIFITSAAPFGPWKEVSTYSSARAGASALANALSKELGEYNIPVFAIAPNYLHTGDSPYYYPSEPWKTSPEHVAHVRKVTALQRLGTQKELGELVTFLASGSCDYLTGQVFWLAGGFPVIERWPGMPE

SEQ ID NO: 671 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagttgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgcaccgttcgggccatggaaggagctatcgacttactcttcggctcgagctggggctagtgcactagctaatgctctatcgaaggagctaggagagtacaatatcccggtgttcgctatcgctccgaattacctacacaccggggattcgccgtactattacccctctgagccgtggaagacttctccggagcacgtggctcacgtgcgtaaggtgactgctctacaacgactagggactcaaaaagagctgggggaattggtgacgtttttggcatctggctcttgtgattatttgactggccaggtgttttggttggcaggcggctttcccgtcatcgaacgttggcccggcatgcccgaataatgaggatcc

SEQ ID NO: 672 - protein, 254 aa, Artificial
  Synthetic Construct
MSTAIVTNVKHFGGMGSALRLSEAGHTVACHDESFKHQDELEAFAETYPQLIPMSEQEPVELIEAVTSALGHVDVLVSNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHTGDSPYYYPSEPWKTSPEHVAHVRKVTALQRLGTQKELGELVTFLASGSCDYLTGQVFWLAGGFPVIERWPGMPE

SEQ ID NO: 673 - DNA, 774 bp, Artificial
  Comment
  CDS (1)..(774)
atgaggaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcggacaggaaccagctgaactgattgaagctgtcaccagcgcccttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgcgttacctacacgacggggattcgccgtaccgctacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggtccggcatgcccgaataatgaggatcc

SEQ ID NO: 674 - protein, 254 aa, Artificial
  Synthetic Construct
MRTAIVTNVKHFGGMGSALRLSEAGHTVACHDESFKHQDELEAFAETYPQLIPMSGQEPAELIEAVTSALGHVDVLVSNDIAPVEWRPIDKYAVEDYRDTVEALQIKPFALVNAVASQMKKRKSGHIIFITSAAPFGPWKELSTYSSARAGASALANALSKELGEYNIPVFAIAPRYLHDGDSPYRYPSEPWKTSPEHVAHVRKVTALQRLGTQKELGELVTFLASGSCDYLTGQVFWLAGGFPVIERWSGMPE

SEQ ID NO: 675 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcggcgtactcttcggctcgagctggggctagtgcactagctaatgctctatcgaaggagctaggagagtacaatatcccggtgttcgctatcgggccgaattacctacactcgattgattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 676 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSAYSSARAGASALANALSKELGEYNIPVFAIGPNYLHSIDSPYYYPTEPWKINPEHVAHVKKVTALQRLGTQKELGELVAFLASGSCDYLTGQVFWLAGGFPVIERWPGMPE

SEQ ID NO: 677 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacattatcttcatcacttcggctgccccgttcgggccatggaaggagctatctgcgtactcttcgtctcgagctgggactagtgcactagctaatgctctatcgaaggagctaggagagtacaatatcccggtgttcgctatcgggccgaattacctacactcgattgattcgccgtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 678 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSAYSSSRAGTSALANALSKELGEYNIPVFAIGPNYLHSIDSPYYYPTEPWKINPEHVAHVKKVTALQRLGTQKELGELVAFLASGSCDYLTGQVFWLAGGFPVIERWPGMPE

SEQ ID NO: 679 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgaagtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggacggcggctttcccgtcatagaacgttggcccggcatgcccgaataatga

SEQ ID NO: 680 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSKYYYPTEPWKINPEHVAHVKKVTALQRLGTQKELGELVAFLASGSCDYLTGQVFWLDGGFPVIERWPGMPE

SEQ ID NO: 681 - DNA, 768 bp, Artificial
  Comment
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgaaaccaatgagcgaacaggaaccagctgaactgattgaagctgtcaccagcgcttttggtcaggtcgatgtcctggtcagcaacgatatctttgctctagaatttcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgggccgaattacctacactcggaggattcgaagtactattaccccactgagccgtggaagattaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 682 - protein, 254 aa, Artificial
  Synthetic Construct
MSTAIVTNVKHFGGMGSALRLSEAGHTVACHDESFKHKDELEAFAETYPQLKPMSEQEPAELIEAVTSAFGQVDVLVSNDIFALEFRPIDKYAVEDYRGAVEALQIRPFALVNAVASQMKKRKSGHIIFITSAAPFGPWKELSTYSSARAGASALANALSKELGEYNIPVFAIGPNYLHSEDSKYYYPTEPWKINPEHVAHVKKVTALQRLGTQKELGELVAFLASGSCDYLTGQVFWLAGGFPVIERWPGMPE

SEQ ID NO: 683 - DNA, 774 bp, Artificial
  Comment
  CDS (1)..(774)
atgaccaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacgggcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacgcttcggctcgagctggggcttgttccctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgctgtggttggcaggcggctttcccatgatagaacgttggcccggcatgcccgaataatgaggatcc

SEQ ID NO: 684 - protein, 254 aa, Artificial
  Synthetic Construct
MTTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYASARAGACSLANALSKELGEYNIPVFAIGPNYLHSEDSPYFYPTEPWKTNPEHVAHVKKVTALQRLGTQKELGELVAFLASGSCDYLTGQVLWLAGGFPMIERWPGMPE

SEQ ID NO: 685 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaactgcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 686 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPELQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 687 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaactgcatccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 688 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPELHPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 689 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttttggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttacacttcggctcgagctggggctagttctctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 690 - protein, 254 aa, Artificial
  Synthetic Construct
MSTAIVTNVKHFGGMGSALRLSEAGHTVACHDESFKQKDELEAFAETYPQLKPMSEQEPAELIEAVTSAFGQVDVLVSNDIFAPEFQPIDKYAVEDYRGAVEALQIRPFALVNAVASQMKKRKSGHIIFITSAAPFGPWKELSTYTSARAGASSLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 691 - DNA, 774 bp, Artificial
  Comment
  CDS (1)..(774)
atgagcaccgctatcgtcaccaacgtcaaacattttggaggtatgggtagcgctctgaggctgagtgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaactgcagccaatcgataaatacgctgtcgaagattacaggggtgctgtcgaagctctgcagatcaggccatttgctgttgtgaatgctgtggcttcgcaaatgaagaagcgaaagtcggggcacatcatcttcatcacttcggctactccgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 692 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPELQPIDKYAVEDYRGAVEALQIRPFAVVNAVASQMKKRKSGHIIFITSATPLGPWKELSTYTSARAGACTLANALSKELGEYNIPVFAIGPNYLHSEDSPYFYPTEPWKTNPEHVAHVKKVTALQRLGTQKELGELVAFLASGSCDYLTGQVFWLAGGFPMIERWPGMPE

SEQ ID NO: 693 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgctggggccatggaaggagctatcgacttacacttcggctcgagctggggcttgtactctggctaatgctctatcgaaggagctaggagagtacaatatcccggtgttcgctatcgggccgaattacctacactcggaggattcgccgtacttctacccgactgagccgtggaagactaatccggagaacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 694 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPLGPWKELSTYTSARAGACTLANALSKELGEYNIPVFAIGPNYLHSEDSPYFYPTEPWKTNPENVAHVKKVTALQRLGTQKELGELVAFLASGSCDYLTGQVFWLAGGFPMIERWPGMPE

SEQ ID NO: 695 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaagtcgaagcttttgctgaaacctacccacagctgaaaccaatgagcgaacaggaaccagctgaactgatcgaagctgtcaccagcgcttacggtcaggtcgatgtcctggtcagcaacgatatctttgctccagaactgcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagaacgtggctcacgtgaagaaggtgactgctctacaacgactagggactcaaaaagagttgggggaattggtggcatttttggcatctggctcttgtgattatttgactggccagctgttttggttggcaggcggctttcccatgatagaacgttggcccggcatgcccgaataatgaggatcc

SEQ ID NO: 696 - protein, 254 aa, Artificial
  Synthetic Construct
MSTAIVTNVKHFGGMGSALRLSEAGHTVACHDESFKQKDEVEAFAETYPQLKPMSEQEPAELIEAVTSAYGQVDVLVSNDIFAPELQPIDKYAVEDYRGAVEALQIRPFALVNAVASQMKKRKSGHIIFITSATPLGPWKELSTYTSARAGACTLANALSKELGEYNIPVFAIGPNYLHSEDSPYFYPTEPWKTNPENVAHVKKVTALQRLGTQKELGELVAFLASGSCDYLTGQLFWLAGGFPMIERWPGMPE

SEQ ID NO: 697 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaagtcgaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggggaacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 698 - protein, 254 aa, Artificial
  Synthetic Construct
MSTAIVTNVKHFGGMGSALRLSEAGHTVACHDESFKQKDEVEAFAETYPQLKPMSEQEPAELIEAVTSAYGQVDVLVSNDIFAPEFQPIDKYAVEDYRGAVEALQIRPFALVNAVASQMKKRKSGHIIFITSATPLGPWKELSTYTSARAGACTLANALSKELGEYNIPVFAIGPNYLHSEDSPYFYPTEPWKTNPGNVAHVKKVTALQRLGTQKELGELVAFLASGSCDYLTGQVFWLAGGFPMIERWPGMPE

SEQ ID NO: 699 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaagtcgaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcgtccaatcgataaatacgctgtcgaagattacaggggtgctgtcgaagctctgcagatcaggccatttgctctagtgaatgctgtggcttcgcaaatgaagaagcgaaagttggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagaacgtggctcacgtgaagaaggtgactgctctacaacgactagggactcaaaaagagttgggggaattggtggcatttttggcatctggctcttgtgattatttgactggccaggtgctgtggttggcaggcggctttcccatgatagaacgttggcccggcatgcccgaataatgaggatcc

SEQ ID NO: 700 - protein, 254 aa, Artificial
  Synthetic Construct
MSTAIVTNVKHFGGMGSALRLSEAGHTVACHDESFKQKDEVEAFAETYPQLKPMSEQEPAELIEAVTSAYGQVDVLVSNDIFAPEFRPIDKYAVEDYRGAVEALQIRPFALVNAVASQMKKRKLGHIIFITSATPFGPWKELSTYTSARAGACTLANALSKELGEYNIPVFAIGPNYLHSEDSPYFYPTEPWKTNPENVAHVKKVTALQRLGTQKELGELVAFLASGSCDYLTGQVLWLAGGFPMIERWPGMPE

SEQ ID NO: 701 - DNA, 768 bp, Artificial
  Comment
  CDS (1)..(768)
atgagcaccgctatcgtcaccaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccaaaatttcagccaatcgataaatacgctgtcgaagattacaggggtgctgtcgaagctctgcagatcaggccatttgctctagggaatgctggggcttcgcaaatgaagaaccaaaagacggtgcacatcatcttcatcacttcggctactccgttcgcatcgtggaaggagctatcgactcacacttctgctcgagctgggggttgtactctaactaatgctctatcgaaggagctaggggagtacaatatgccggagctagctatcgaggcgaattacctacactcgggggattcatcggacttctacacgactgagccgaggaagactaatccggagaacgtgcttcacctgaagaaggtgactggtctacaacgactagggactcaaaaagagctgggggaattggtggcatttttggaatcaggctcttgtgattatttgactggccaggtgctttgcttgccaggcggctttcccctgatagaacgttggcccggcatgcccgaataatga

SEQ ID NO: 702 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPKFQPIDKYAVEDYRGAVEALQIRPFALGNAGASQMKNQKTVHIIFITSATPFASWKELSTHTSARAGGCTLTNALSKELGEYNMPELAIEANYLHSGDSSDFYTTEPRKTNPENVLHLKKVTGLQRLGTQKELGELVAFLESGSCDYLTGQVLCLPGGFPLIERWPGMPE

SEQ ID NO: 703 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagaacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 704 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPENVAHVKKVTALQRLGTQKELGELVAFLASGSCDYLTGQVFWLAGGFPMIERWPGMPE

SEQ ID NO: 705 - DNA, 774 bp, Artificial
  Comment
  CDS (1)..(774)
atgagcaccgctatcgtcaccaacgtcaaacatttcggaggtatgggtagcgctctgaggctgagcgaagctggtcataccgtcgcttgccatgatgaaagctttaaacacaaagatgatctggaagcttttgctgaaacctacccacagctgaaaccaatgagcgaacaggaaccagccgaactgatcgaagctgtcaccagcgcttacggtcaggtcgatgtcctggtcagcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcgtctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgagcgagccgtggaagactaatccggagcacatggctcacgtgaagaaggtgactgctctacaacgactagggactcaaaaagagttgggggaattggtggcatttttggcatctggctcttgtgattatttgactggccagatgttttggttggcaggcggctttcccatgatagaacgttggcccggcatgcccgaataatgaggatcc

SEQ ID NO: 706 - protein, 254 aa, Artificial
  Synthetic Construct
MSTAIVTNVKHFGGMGSALRLSEAGHTVACHDESFKHKDDLEAFAETYPQLKPMSEQEPAELIEAVTSAYGQVDVLVSNDIFAPEFQPIDKYAVQDYRGAVEALQIRPFALVNAVASQMKKRKSGHIIFITSSTPFGPWKELSTYTSARAGACTLANALSKELGEYNIPVFAIGPNYLHSEDSPYFYPSEPWKTNPEHMAHVKKVTALQRLGTQKELGELVAFLASGSCDYLTGQMFWLAGGFPMIERWPGMPE

SEQ ID NO: 707 - DNA, 774 bp, Artificial
  Comment
  CDS (1)..(774)
atgagcaccgctatcgtcaccaatgtcaaacattttggaggtatgggtagcgctctgaggctgagcgaagctggtcataccgtcgcttgccatgatgaaagctttaaacacaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgacaaatacgctgtcgaagattacaggggtgctgtcgaagctctgcagatcaggccatttgctctagtgaatgctgtggcttcgcaaatgaagaaacgaaagtcggggcacatcatcttcatcacttcggctactccgttcgggccacggaaagagctatcgacttacacttcggctcgggctggggcttgtactctagctaatgctctatcgaaggagctaggagagtacaatatcccggtgttcgctatcgggccgaattacctacactcggaggattcgccgtacttctacccgactgagccgtggaagactaatccggagcacatggctcacgtgaagaaggtgactgctctacaacgactagggactcaaaaagagttgggggaattggtggcatttttggcatctggctcttgtgattatttgactggccaggtgttttggttggcaggcggctttcccctaatagaacgttggcccggcatgcccgaataatgaggatcc

SEQ ID NO: 708 - protein, 254 aa, Artificial
  Synthetic Construct
MSTAIVTNVKHFGGMGSALRLSEAGHTVACHDESFKHKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPRKELSTYTSARAGACTLANALSKELGEYNIPVFAIGPNYLHSEDSPYFYPTEPWKTNPEHMAHVKKVTALQRLGTQKELGELVAFLASGSCDYLTGQVFWLAGGFPLIERWPGMPE

SEQ ID NO: 709 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacatggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 710 - protein, 254 aa, Artificial; identical to SEQ ID NO: 24
  Synthetic Construct

SEQ ID NO: 711 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccgtggaaggagctatcgacttacacttcggctcgagctggggcttgtactctagctaatgctctatcgaaggagctgggtaagtacaatatcccggtgttcgctatcgggccgaattacctacactcggaggattcgccgtacttctacccgactgagccgtggaagactaatccggagcacatggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 712 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGKYNIPVFAIGPNYLHSEDSPYFYPTEPWKTNPEHMAHVKKVTALQRLGTQKELGELVAFLASGSCDYLTGQVFWLAGGFPMIERWPGMPE

SEQ ID NO: 713 - DNA, 774 bp, Artificial
  Comment
  CDS (1)..(774)
atgagcaccgctatcgtcactaacgtcaaacattttggtggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctgatgaatgctgtgacttctcaaatgaagaagcgaaagtcggggcacatcatcttcatcacttcggctactccgttcgggccgtggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacatggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 714 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVEDYRGAVEALQIRPFALMNAVTSQMKKRKSGHIIFITSATPFGPWKELSTYTSARAGACTLANALSKELGEYNIPVFAIGPNYLHSEDSPYFYPTEPWKTNPEHMAHVKKVTALQRLGTQKELGELVAFLASGSCDYLTGQVFWLAGGFPMIERWPGMPE

SEQ ID NO: 715 - DNA, 774 bp, Artificial
  Comment
  CDS (1)..(774)
atgagcaccgtcatcgtcaccaacgtcaaacattttggaggtatgggtagcgctctgaggctgagcgaagctggtctgaccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacatggctcacgtgaagaaggtgactgctctacaacgactagggactcaaaaagagttgggggaattggtggcatttttggcatctggctcttgtgattatttgactggccaggtgttttggttgaccggcggctttcccatgatagaacgttggcccggcatgcccgaataatgaggatcc

SEQ ID NO: 716 - protein, 254 aa, Artificial
  Synthetic Construct
MSTVIVTNVKHFGGMGSALRLSEAGLTVACHDESFKQKDELEAFAETYPQLKPMSEQEPAELIEAVTSAYGQVDVLVSNDIFAPEFQPIDKYAVEDYRGAVEALQIRPFALVNAVASQMKKRKSGHIIFITSATPFGPWKELSTYTSARAGACTLANALSKELGEYNIPVFAIGPNYLHSEDSPYFYPTEPWKTNPEHMAHVKKVTALQRLGTQKELGELVAFLASGSCDYLTGQVFWLTGGFPMIERWPGMPE

SEQ ID NO: 717 - DNA, 768 bp, Artificial
  Comment
  CDS (1)..(768)
atgagcaccgccattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgataccaatgagcgaacaggaaccagctgaactgattgaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaagaagagttgggggaattggtgacatttttggcatctggctcttgtgattatttgactggccaggtgttttggttggcaggcggatttcccgtcatcgaacgttggcccggcatgcccgaataatga

SEQ ID NO: 718 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGQVDVLVSNDIAAVEWRPIDKYAVEDYRGTVEALQIKPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQEELGELVTFLASGSCDYLTGQVFWLAGGFPVIERWPGMPE

SEQ ID NO: 719 - DNA, 774 bp, Artificial
  Comment
  CDS (1)..(774)
atgagcaccgctaccgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaactgcgtccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgctggggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaagaagagttgggggaattggtggcatttttggcatctggctcttgtgattatttgactggccagctgttttggttggcaggcggcttccccatgatagaacgttggcccggcatgcccgaataatgaggatcc

SEQ ID NO: 720 - protein, 254 aa, Artificial
  Synthetic Construct
MSTATVTNVKHFGGMGSALRLSEAGHTVACHDESFKQKDELEAFAETYPQLKPMSEQEPAELIEAVTSAYGQVDVLVSNDIFAPELRPIDKYAVEDYRGAVEALQIRPFALVNAVASQMKKRKSGHIIFITSATPLGPWKELSTYTSARAGACTLANALSKELGEYNIPVFAIGPNYLHSEDSPYFYPTEPWKTNPEHVAHVKKVTALQRLGTQEELGELVAFLASGSCDYLTGQLFWLAGGFPMIERWPGMPE

SEQ ID NO: 721 - DNA, 774 bp, Artificial
  Comment
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtccaggattacaggggtgctgtcgaagctctgcagatcaggccatttgctctagtgaatgctgtggcttcgcaaatgaagaagcgaaagtcggggcacatcatcttcatcacttcggctagtccgttcgggccatggaaggagctatcgacttacacttcggctcgagctggggcttgttccctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaagaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 722 - protein, 254 aa, Artificial
  Synthetic Construct
MSTAIVTNVKHFGGMGSALRLSEAGHTVACHDESFKQKDELEAFAETYPQLKPMSEQEPAELIEAVTSAYGQVDVLVSNDIFAPEFQPIDKYAVQDYRGAVEALQIRPFALVNAVASQMKKRKSGHIIFITSASPFGPWKELSTYTSARAGACSLANALSKELGEYNIPVFAIGPNYLHSEDSPYFYPTEPWKTNPEHVAHVKKVTALQRLGTQEELGELVAFLASGSCDYLTGQVFWLAGGFPMIERWPGMPE

SEQ ID NO: 723 - DNA, 774 bp, Artificial
  Comment
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcgtttgccgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgatagatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattaccccactgagccgtggaagacttctctggagcacgtggctcacgtgcgtaaggtgactgctctacaacgactagggactcaagaagagttgggggaattggtgacgtttttggcatctggctcttgtgattatttgactggccaggtgttttggttgacaggcggctttcccgtcatcgaacgttggcccggcatgcccgaataatgaggatcc

SEQ ID NO: 724 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDRYAVEDYRDTVEALQIKPFALVNAVASQMKKRKSGHIIFITSAAPFGPWKELSTYSSARAGASALANALSKELGEYNIPVFAIAPNYLHSGDSPYYYPTEPWKTSLEHVAHVRKVTALQRLGTQEELGELVTFLASGSCDYLTGQVFWLTGGFPVIERWPGMPE

SEQ ID NO: 725 - DNA, 768 bp, Artificial
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgatcccaatgagcgaacaggaaccagctgaactgattgaagctgtcaccagcgctcttggtcaggtcgatgtactggtcagcaacgatatctatcctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattaccccactgagccgtggaagacttctccggagcacgtggctcacgtgcgtaaggtgactgctctacaacgactagggactcaaaaagagctgggggaattggtggcatttttggcatctggctcttgtgattatttgactggccaggtgttttggttgacaggcggctttcccgtcatcgaacgttggcccggcatgcccgaataatga

SEQ ID NO: 726 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGQVDVLVSNDIYPVEWRPIDKYAVEDYRGTVEALQIKPFALVNAVASQMKKRKSGHIIFITSAAPFGPWKELSTYSSARAGASALANALSKELGEYNIPVFAIAPNYLHSGDSPYYYPTEPWKTSPEHVAHVRKVTALQRLGTQKELGELVAFLASGSCDYLTGQVFWLTGGFPVIERWPGMPE

SEQ ID NO: 727 - DNA, 765 bp, Artificial; identical to SEQ ID NO: 45
  CDS (1)..(765)

SEQ ID NO: 728 - protein, 254 aa, Artificial; identical to SEQ ID NO: 46
  Synthetic Construct

SEQ ID NO: 729 - DNA, 768 bp, Artificial
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatga

SEQ ID NO: 730 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVNAVASQMKKRKSGHIIFITSAAPFGPWKELSTYSSARAGASALANALSKELGEYNIPVFAIAPNYLHSGDSPYYYPSEPWKTSPEHVAHVRKVTALQRLGTQKELGELVTFLASGSCDYLTGQVFWLAGGFPVIERWPGMPE

SEQ ID NO: 731 - DNA, 768 bp, Artificial
  CDS (1)..(768)
atgagcaccgctattgtcaccaacgtcaaacattttggaggtatgggtagcgctctgaggctgagcgaagctggtcataccgtcgcttgccatgatgaaagctttaagcataaagatgaactggaagcttttgctgaaacctacccacagctgcgtccaatgagcgaacaggaaccagctgaactgattgaagctgtcaccagcgcttttggtcaggtcgatgtcctggtcagcaacgatatcgctgctgtggaatggcggccaatcgataaatacgctgtcgaggattacaggggtgctgtcgaagctctgcagatcaggccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattaccccactgagccgtggaagattaatccggagcacgtgactcacgtgcgtaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 732 - protein, 254 aa, Artificial
  Synthetic Construct
MSTAIVTNVKHFGGMGSALRLSEAGHTVACHDESFKHKDELEAFAETYPQLRPMSEQEPAELIEAVTSAFGQVDVLVSNDIAAVEWRPIDKYAVEDYRGAVEALQIRPFALVNAVASQMKKRKSGHIIFITSAAPFGPWKELSTYSSARAGASALANALSKELGEYNIPVFAIAPNYLHSEDSPYYYPTEPWKINPEHVTHVRKVTALQRLGTQKELGELVAFLASGSCDYLTGQVFWLAGGFPVIERWPGMPE

SEQ ID NO: 733 - DNA, 768 bp, Artificial
  CDS (1)..(768)
atgagcaccgctattgtcacgaacgtcaaacattttggaggtatgggtagcgctctgaggctgagcgaagctggtcataccgtcgcttgccatgatgaaagctttaagcataaagatgaactggaagcttttgctgacgcctacccacagctgataccaatgagcgaacaggaaccagctgaactgattgaagctgtcaccagcgcttttggtcatgtcgatgtcctggtcagcaacgatatcgctgctgtggaatggcggccaatcgataaatacgctgtcgaggattacaggggtgctgtcgaagctctgcagatccgcccatttgctctagtgaatgctgtggcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtggcatttttggcatctggctcttgtgattatttgactggccaggtgttttggttggcaggcggctttcccgtcatagaacgttggcccggcatgcccgaataatga

SEQ ID NO: 734 - protein, 254 aa, Artificial
  Synthetic Construct
MSTAIVTNVKHFGGMGSALRLSEAGHTVACHDESFKHKDELEAFADAYPQLIPMSEQEPAELIEAVTSAFGHVDVLVSNDIAAVEWRPIDKYAVEDYRGAVEALQIRPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVAFLASGSCDYLTGQVFWLAGGFPVIERWPGMPE

SEQ ID NO: 735 - DNA, 768 bp, Artificial
  CDS (1)..(768)
atgagcaccgctattgtcaccaacgtcaaacattttggaggtatgggtagcgctctgcgtctgagcgaagctggtcataccgtcgcttgccatgatgaaagctttaagcatcaggatgaactggaagcttttgctgaaacctacccacagctgataccaatgagcgaacaggaaccagctgaactgattgaagctgtcaccagcgctcttggtcaggtcgatgtcctggtcagcaacgatatcgctgctgtggaatggcggccaatcgataaatacgctgtcgaggattacaggggtactgtcgaagctctgcagatcaagccatttgctctagtgaatgctgtcgcttcgcaaatgaagaagcgaaagtcggggcacatcatcttcatcacttcggctgccccgttcgggccatggaaggagctatcgacttactcttcggctcgagctggggctagtgcactagctaatgctctatcgaaggagctaggagagtacaatatcccggtgttcgctatcgctccgaattacctacactcggaggattcgccgtactattacccctctgagccgtggaagacttctccggagcacgtggctcacgtgcgtaaggtgactgctctacaacgactagggactcaaaaagagttgggggaattggtgacatttttggcatctggctcttgtgattatttgactggccaggtgttttggttggcaggcggctttcccgtcatcgaacgttggcccggcatgcccgaataatga

SEQ ID NO: 736 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGQVDVLVSNDIAAVEWRPIDKYAVEDYRGTVEALQIKPFALVNAVASQMKKRKSGHIIFITSAAPFGPWKELSTYSSARAGASALANALSKELGEYNIPVFAIAPNYLHSEDSPYYYPSEPWKTSPEHVAHVRKVTALQRLGTQKELGELVTFLASGSCDYLTGQVFWLAGGFPVIERWPGMPE

SEQ ID NO: 737 - DNA, 774 bp, Artificial
  CDS (1)..(774)
atgagcaccgctattgtcaccaacgtcaaacattttggaggtatgggtagcgctctgcgtctgagcgaagctggtcataccgtcgcttgccatgatgaaagctttaagcatcaggatgaactagaagcttttgctgaaacctacccacagctgataccaatgagcgaacaggaaccagctgaactgattgaagctgtcaccagcgctcttggtcatgtcgatgtcctggtcagcaacgatatcgcgcctgtggaatggcggccaatcgataaatacgctgtcgaggattacagggatactgtcgaagctctgcagatcaagccatttgctctagtgaaggctgtcgcttcgcaaatgaagaagcgaaagtcggggcacatcatcttcatcacttcggctgccccgttcgggccacgtaaggagatctcgacttactcttcggctcgagctggggctagtgcactagctaatgctctatcgaaggagctaggagtagacaatatcccggtgttcgctatcgctccggagtacctacactcgggggattcgccgtactattacccctctgagccgtggaagacttctccggagcacgtggctcacgtgcgtaaggtgactgctctacaacgactagggactcaaaaagagttgggggaattggtgacgtttttggcatctggctcttgtgattatttgactggccaggtgttttggttggcaggcggctttcccgtcatcgaacgttggcccggcatgcccgaataatgaggatcc

SEQ ID NO: 738 - protein, 254 aa, Artificial
  Synthetic Construct
MSTAIVTNVKHFGGMGSALRLSEAGHTVACHDESFKHQDELEAFAETYPQLIPMSEQEPAELIEAVTSALGHVDVLVSNDIAPVEWRPIDKYAVEDYRDTVEALQIKPFALVKAVASQMKKRKSGHIIFITSAAPFGPRKEISTYSSARAGASALANALSKELGVDNIPVFAIAPEYLHSGDSPYYYPSEPWKTSPEHVAHVRKVTALQRLGTQKELGELVTFLASGSCDYLTGQVFWLAGGFPVIERWPGMPE

SEQ ID NO: 739 - DNA, 774 bp, Artificial
  CDS (1)..(774)
atgagcaccgctatcgtcaccaacgtcaaacattttggaggtatgggtagcgctctgaggctgagcgaagctggtcataccgtcgcttgccatgatgaaagctttaaacagaaagatgaactggaagcttttgctgaaacctacccacagctgaaaccaatgagcgaacaggaaccagctgaactgatcgaagctgtcaccagcgcttacggtcaggtcgatgtcctggtcagcaacgatatctttgctccagaatttcagccaatcgataaatacgctgtcgaagattacaggggtgctgtcgaagctctgcagatcaggccatttgctctagtgaatgctgtggcttcgcaaatgaagaagcgaaagtcggggcacatcatcttcatcacttcggctactccgttcgggccatggaaggagctatcgacttacacttcggctcgagctggggcttgtactctagctaatgctctatcgaaggagctaggagagtacaatatcccggtgttcgctatcgggccgaattacctacactcggaggattcgccgtacttctacccgactgagccgtggaagactaatccggagcacgtggctcacgtgaagaaggtgactgctctacaacgactagggactcaaaaagagttgggggaattggtggcatttttggcatctggctcttgtgattatttgactggccaggtgttttggttggcaggcggctttcccatgatagaacgttggcccggcatgcccgaataatgaggatcc

SEQ ID NO: 740 - protein, 254 aa, Artificial; identical to SEQ ID NO: 2
  Synthetic Construct

SEQ ID NO: 741 - DNA, 765 bp, Artificial; identical to SEQ ID NO: 69
  CDS (1)..(765)

SEQ ID NO: 742 - protein, 254 aa, Artificial; identical to SEQ ID NO: 70
  Synthetic Construct

What is claimed is:

1. A recombinant halohydrin dehalogenase (HHDH) polypeptide capable of converting ethyl (S)-4-chloro-3-hydroxybutyrate to ethyl (R)-4-cyano-3-hydroxybutyrate with at least 1.4-fold greater HHDH activity than the wild-type *Agrobacterium* sp. HHDH polypeptide of SEQ ID NO:2, wherein said recombinant HHDH polypeptide comprises an amino acid sequence that is at least 93% identical to SEQ ID NO:442 and includes an Alanine at the residue position that corresponds to position 134 of SEQ ID NO:2.

2. The polypeptide of claim 1, which further comprises Isoleucine at the residue position that corresponds to position 75 of SEQ ID NO:2.

3. The polypeptide of claim 1, which further comprises Serine at the residue position that corresponds to position 153 of SEQ ID NO:2.

4. The polypeptide of claim 1, which further comprises Tyrosine at the residue position that corresponds to position 186 of SEQ ID NO:2.

5. The polypeptide of claim 1, which has an amino acid sequence selected from the group consisting of: SEQ ID NO: 442, 726, 730, 734, 736, and 738.

6. The polypeptide of claim 1, which is capable of converting ethyl (S)-4-chloro-3-hydroxybutyrate to ethyl (R)-4-cyano-3-hydroxybutyrate with at least 2-fold greater HHDH activity as compared to the wild-type *Agrobacterium* sp. HHDH polypeptide of SEQ ID NO: 2, and which comprises an amino acid sequence selected from the group consisting of SEQ ID NO: 726, 730, 734, and 736.

7. The polypeptide of claim 1, further capable of increased resistance to inhibition by ethyl-4-chloroacetoacetate (ECAA) and wherein the amino acid sequence further includes one or more residues selected from the group consisting of: Valine at the residue position that corresponds to position 4 of SEQ ID NO:2, Tyrosine at the residue position that corresponds to position 82 of SEQ ID NO:2, Tryptophan at the residue position that corresponds to position 136 of SEQ ID NO:2, Valine at the residue positioncorresponds to position 136 of SEQ ID NO:2, Arginine at the residue position that corresponds to position 142 of SEQ ID NO:2, Valine at the residue position that corresponds to position 178 of SEQ ID NO:2, Leucine at the residue position that corresponds to position 238 of SEQ ID NO:2, Threonine at the residue position that corresponds to position 240 of SEQ ID NO:2, Tyrosine at the residue position that corresponds to position 249 of SEQ ID NO:2, and Isoleucine at the residue position that corresponds to position 252 of SEQ ID NO:2.

8. The polypeptide of claim 1, which has at least 2-fold greater HHDH activity as compared to the wild-type *Agrobacterium* sp. HHDH polypeptide of SEQ ID NO:2.

* * * * *